United States Patent
Meinke et al.

(10) Patent No.: US 11,684,669 B2
(45) Date of Patent: Jun. 27, 2023

(54) CPG-ADJUVANTED SARS-COV-2 VIRUS VACCINE

(71) Applicants: Valneva Austria GmbH, Vienna (AT); Dynavax Technologies Corporation, Emeryville, CA (US)

(72) Inventors: Andreas Meinke, Pressbaum (AT); Michael Möhlen, Vienna (AT); Christoph Reinisch, Siegenfeld (AT); Robert Schlegl, Siegenfeld (AT); Christian Taucher, Vienna (AT); John Campbell, Emeryville, CA (US); David Novack, Emeryville, CA (US); Robert S. Janssen, Emeryville, CA (US); Jürgen Heindl-Wruss, Vienna (AT)

(73) Assignees: Valneva Austria GmbH, Vienna (AT); Dynavax Technologies Corporation, Emeryville, CA (US)

( * ) Notice: Subject to any disclaimer, the term of this patent is extended or adjusted under 35 U.S.C. 154(b) by 0 days.

(21) Appl. No.: 17/471,904

(22) Filed: Sep. 10, 2021

(65) Prior Publication Data

US 2023/0038284 A1 Feb. 9, 2023

Related U.S. Application Data

(63) Continuation of application No. PCT/IB2021/052858, filed on Apr. 6, 2021, and a (Continued)

(30) Foreign Application Priority Data

Apr. 6, 2020 (EP) ...................................... 20168324
Oct. 15, 2020 (EP) ...................................... 20202124

(Continued)

(51) Int. Cl.
*C12N 7/00* (2006.01)
*A61K 39/215* (2006.01)
*A61K 39/00* (2006.01)

(52) U.S. Cl.
CPC ...... *A61K 39/215* (2013.01); *A61K 2039/545* (2013.01); *A61K 2039/55561* (2013.01)

(58) Field of Classification Search
None
See application file for complete search history.

(56) References Cited

U.S. PATENT DOCUMENTS 6,309,650 B1 10/2001 Kim et al.
6,589,940 B1 7/2003 Raz et al.
(Continued)

FOREIGN PATENT DOCUMENTS

CN 1827936 A 9/2006
CN 101240271 A 8/2008
(Continued)

OTHER PUBLICATIONS

Zhang et al., "Progress and Prospects on Vaccine Development against SARS-CoV-2," Vaccines 8: 153 (Year: 2020).*
(Continued)

*Primary Examiner* — M Franco G Salvoza

(57) ABSTRACT

Described herein are CpG-adjuvanted SARS-CoV-2 vaccines and compositions and methods of producing and administering said vaccines to subjects in need thereof.

30 Claims, 54 Drawing Sheets

Specification includes a Sequence Listing.

Related U.S. Application Data continuation of application No. PCT/US2021/020313, filed on Mar. 1, 2021.

(60) Provisional application No. 62/983,737, filed on Mar. 1, 2020.

(30) Foreign Application Priority Data

| Dec. 4, 2020 | (EP) | ................................. | 20211936 |
| Feb. 1, 2021 | (EP) | ................................. | 21154645 |
| Mar. 5, 2021 | (EA) | ................................. | 21160933 |

(56) References Cited

U.S. PATENT DOCUMENTS

| 10,953,089 | B1* | 3/2021 | Smith .................. A61K 39/215 |
| 11,213,482 | B1* | 1/2022 | Gambotto ......... A61M 37/0015 |
| 2006/0257852 | A1* | 11/2006 | Rappuoli ............... C12Q 1/701 |
| | | | 435/69.3 |
| 2007/0116716 | A1 | 5/2007 | Shen et al. |
| 2009/0017069 | A1* | 1/2009 | Akeefe .................... A61P 11/00 |
| | | | 435/235.1 |
| 2009/0104229 | A1 | 4/2009 | Voss |
| 2011/0052621 | A1 | 3/2011 | Champion et al. |
| 2017/0246281 | A1* | 8/2017 | Super ...................... A61P 31/04 |
| 2019/0134190 | A1 | 5/2019 | Rittner et al. |
| 2021/0260181 | A1* | 8/2021 | Georges ............... A61K 39/215 |
| 2021/0308257 | A1 | 10/2021 | Kou et al. |

FOREIGN PATENT DOCUMENTS

| CN | 102068692 | A | | 5/2011 | |
| EP | 1411979 | A1 | | 4/2004 | |
| EP | 2484378 | A1 | | 8/2012 | |
| EP | 19196192.9 | | | 9/2019 | |
| WO | WO-0020039 | A1 | * | 4/2000 | ............. A61K 39/39 |
| WO | WO 2000/062802 | A2 | | 10/2000 | |
| WO | WO 2001/000232 | A2 | | 1/2001 | |
| WO | WO 2003/011334 | A1 | | 2/2003 | |
| WO | WO 2004/092360 | A2 | | 10/2004 | |
| WO | 2004/094614 | A2 | | 11/2004 | |
| WO | WO 2005/111238 | A2 | | 11/2005 | |
| WO | WO 2007/122392 | A1 | | 11/2007 | |
| WO | WO 2013/083726 | A1 | | 6/2013 | |
| WO | WO 2014/153087 | A1 | | 9/2014 | |
| WO | WO 2016/203025 | A1 | | 12/2016 | |
| WO | WO 2017/109223 | A1 | | 6/2017 | |
| WO | WO 2017/109225 | A1 | | 6/2017 | |
| WO | WO 2018/147265 | A1 | | 8/2018 | |
| WO | WO 2018/200645 | A1 | | 11/2018 | |
| WO | WO 2019/057793 | A1 | | 3/2019 | |
| WO | WO 2021/048221 | A1 | | 3/2021 | |
| WO | WO 2021/178306 | A1 | | 9/2021 | |
| WO | WO 2021/178318 | A1 | | 9/2021 | |
| WO | WO 2021/178321 | A1 | | 9/2021 | |
| WO | WO 2021/178877 | A1 | | 9/2021 | |
| WO | WO 2021/204825 | A2 | | 10/2021 | |
| WO | WO 2021/254473 | A1 | | 12/2021 | |

OTHER PUBLICATIONS

Bao et al., "Anti-SARS-CoV immunity induced by a novel CpG oligodeoxynucleotide," Clinical Immunology 118: 180-187 (Year: 2006).*
Zhao et al., "The immune responses of HLA-A*0201 restricted SARS-CoV S peptide-specific CD8+ T cells are augmented in varying degrees by CpG ODN, PolyI:C and R848," Vaccine 29: 6670-6678 (Year: 2011).*
Zakhartchouk et al., "Immunogenicity of a receptor-binding domain of SARS coronavirus spike protein in mice: Implications for a subunit vaccine,"Vaccine 25: 136-143 (Year: 2007).*
Wan et al., "Molecular Mechanism for Antibody-Dependent Enhancement of Coronavirus Entry," Journal of Virology, 94: e02015-19 (Year: 2020).*
Wang et al., "The potential for antibody-dependent enhancement of SARS-CoV-2 infection: Transnational implications for vaccine development," Journal of Clinical and Translational Science, p. 1 of 4 (Year: 2020).*
Kulkarni, "Antibody-Dependent Enhancement of Viral Infections," Dynamics of immune activation in viral diseases, Nov. 5: 9-41 (Year: 2019).*
[No Author Listed], What's in vaccines? The Centers for Disease Control and Prevention. 2021. https://www.cdc.gov/vaccines/parents/ingredients.html. [Last Accessed Mar. 10, 2021].
Abdullah et al., SARS-CoV-2: a piece of bad news. Medeni Med J. 2020;35(2):151-160. Epub Jun. 30, 2020.
Afrough et al., Emerging viruses and current strategies for vaccine intervention. Clin Exp Immunol. May 2019;196(2):157-166.
Agrawal et al., Immunization with inactivated Middle East Respiratory Syndrome coronavirus vaccine leads to lung immunopathology on challenge with live virus. Hum Vaccin Immunother. Sep. 2016;12(9):2351-6. doi: 10.1080/21645515.2016.1177688. Epub Jun. 7, 2016.
Ahmed et al., Preliminary identification of potential vaccine targets for the COVID-19 coronavirus (SARS-CoV-2) based on SARS-CoV immunological studies. Viruses. Feb. 25, 2020;12(3):254.
Altschul et al., Basic local alignment search tool. J Mol Biol. Oct. 5, 1990;215(3):403-10.
Altschul et al., Gapped BLAST and PSI-BLAST: a new generation of protein database search programs. Nucleic Acids Res. Sep. 1, 1997;25(17):3389-402.
Amanat et al., A serological assay to detect SARS-CoV-2 seroconversion in humans. MedRxiv [Preprint] posted Apr. 16, 2020 [cited May 12, 2020. Available from https://doi.org/10.1101/2020.03.17.20037713, 12 pages.
Bao et al., Reinfection could not occur in SARS-CoV-2 infected rhesus macaques. BioRxiv 2020.03.13.990226 [Preprint] posted May 1, 2020 [cited Mar. 13, 2020]. Available from https://doi.org/10.1101/2020.03.13.990226, 20 pages.
Berger A., Th1 and Th2 responses: what are they? BMJ. Aug. 12, 2000;321(7258):424.
Bode et al., CpG DNA as a vaccine adjuvant. Expert Rev Vaccines. Apr. 2011;10(4):499-511. doi: 10.1586/erv.l0.174. Author Manuscript. 22 pages.
Braun et al., Immunogenic duplex nucleic acids are nuclease resistant. J Immunol. Sep. 15, 1988;141(6):2084-9.
Campbell J.D., Development of the CpG adjuvant 1018: a case study. Methods Mol Biol. 2017;1494:15-27.
Capobianchi et al., Molecular characterization of SARS-CoV-2 from the first case of COVID-19 in iItaly. Clin Microbiol Infect. Jul. 2020;26(7):954-956. doi: 10.1016/j.cmi.2020.03.025. Epub Mar. 27, 2020.
Chan et al., Genomic characterization of the 2019 novel human-pathogenic coronavirus isolated from a patient with atypical pneumonia after visiting Wuhan. Emerg Microbes Infect. Jan. 28, 2020;9(1):221-236. Erratum in: Emerg Microbes Infect. Dec. 2020;9(1):540.
Chuang et al., Toll-like receptor 9 mediates CpG-DNA signaling. J Leukoc Biol. Mar. 2002;71(3):538-44.
Coffman et al., Vaccine adjuvants: putting innate immunity to work. Immunity. Oct. 29, 2010;33(4):492-503. Author Manuscript, 21 pages.
Corpet F., Multiple sequence alignment with hierarchical clustering. Nucleic Acids Res. Nov. 25, 1988;16(22):10881-90.
Darnell et al., Inactivation of the coronavirus that induces severe acute respiratory syndrome, SARS-CoV. J Virol Methods. Oct. 2004;121(1):85-91.
Deng et al., Enhanced protection in mice induced by immunization with inactivated whole viruses compare to spike protein of middle east respiratory syndrome coronavirus. Emerg Microbes Infect. Apr. 4, 2018;7(1):60.
Devereux et al., A comprehensive set of sequence analysis programs for the VAX. Nucleic Acids Res. Jan. 11, 1984;12(1):387-95.

(56) References Cited

OTHER PUBLICATIONS

Draper et al., Malaria Vaccines: Recent Advances and New Horizons. Cell Host Microbe. Jul. 11, 2018;24(1):43-56. doi: 10.1016/j.chom.2018.06.008.

Enjuanes et al., Molecular Basis of Coronavirus Virulence and Vaccine Development. Adv Virus Res. 2016;96:245-286. doi: 10.1016/bs.aivir.2016.08.003.

Excler et al., Vaccine development for emerging infectious diseases. Nat Med. Apr. 2021;27(4):591-600. Epub Apr. 12, 2021.

Feng et al., Progressive sequence alignment as a prerequisite to correct phylogenetic trees. J Mol Evol. 1987;25(4):351-60.

Ferguson et al., Report 9: impact of non-pharmaceutical interventions (NPIs) to reduce COVID-19 mortality and healthcare demand. Imperial College London. Mar. 16, 2020. doi:; https://doi.org/10.25561/77482.

Francica et al., Innate transcriptional effects by adjuvants on the magnitude, quality, and durability of HIV envelope responses in NHPs. Blood Adv. Nov. 17, 2017;1(25):2329-2342. doi: 10.1182/bloodadvances.2017011411. Erratum in: Blood Adv. Mar. 13, 2018;2(5):516.

Frieman et al., Molecular determinants of severe acute respiratory syndrome coronavirus pathogenesis and virulence in young and aged mouse models of human disease. J Virol. Jan. 2012;86(2):884-97. Epub Nov. 9, 2011.

GENBANK Submission; NIH/NCBI, Accession No. MN908947.3. Wu et al., Mar. 18, 2020. 13 pages.

GENBANK Submission; NIH/NCBI, Accession No. MT066156. Capobianchi et al., Apr. 13, 2020. 13 pages.

Glass et al., Mechanisms of host defense following severe acute respiratory syndrome-coronavirus (SARS-CoV) pulmonary infection of mice. J Immunol. Sep. 15, 2004;173(6):4030-9.

Graham et al., Emerging viral diseases from a vaccinology perspective: preparing for the next pandemic. Nat Immunol. Jan. 2018;19(1):20-28. Epub Dec. 14, 2017.

Han et al., Coronavirus 2019-nCoV: A brief perspective from the front line. J Infect. Apr. 2020;80(4):373-377. doi: 10.1016/j.jinf.2020.02.010. Epub Feb. 25, 2020.

Henikoff et al., Amino acid substitution matrices from protein blocks. Proc Natl Acad Sci U S A. Nov. 15, 1992;89(22):10915-9.

Higgins et al., CLUSTAL: a package for performing multiple sequence alignment on a microcomputer. Gene. Dec. 15, 1988;73(1):237-44.

Higgins et al., Fast and sensitive multiple sequence alignments on a microcomputer. Comput Appl Biosci. Apr. 1989;5(2):151-3.

Hogan et al., Resolution of primary severe acute respiratory syndrome-associated coronavirus infection requires Stat1. J Virol. Oct. 2004;78(20):11416-21.

Hombach et al., Report on a WHO consultation on immunological endpoints for evaluation of new Japanese encephalitis vaccines, WHO, Geneva, Sep. 2-3, 2004. Vaccine. Nov. 1, 2005;23(45):5205-11. Epub Jul. 18, 2005.

Hotez et al., COVID-19 vaccines: neutralizing antibodies and the alum advantage. Nat Rev Immunol. Jul. 2020;20(7):399-400.

Huang et al., Parallelization of a local similarity algorithm. Comput Appl Biosci. Apr. 1992;8(2):155-65.

Huh et al., Emergent Strategies for the Next Phase of COVID-19. Infect Chemother. Mar. 2020;52(1):105-109. doi: 10.3947/ic.2020.52.1.105. Epub Feb. 25, 2020.

Ioannou et al., CpG-containing oligodeoxynucleotides, in combination with conventional adjuvants, enhance the magnitude and change the bias of the immune responses to a herpesvirus glycoprotein. Vaccine. Nov. 22, 2002;21(1-2):127-37.

Khan, We've never made a successful vaccine for a coronavirus before. This is why it's so difficult. ABC Health & Wellbeing: Health Report. Accessed on Sep. 20, 2021. Accessible at www.abc.net.au/news/health/2020-04-17/coronavirus-vaccine-ian-frazer/12146616. Epub Apr. 17, 2020. 6 pages.

Kobinger et al., Adenovirus-based vaccine prevents pneumonia in ferrets challenged with the SARS coronavirus and stimulates robust immune responses in macaques. Vaccine. Jul. 9, 2007;25(28):5220-31. Epub May 7, 2007.

Lambert et al., Consensus summary report for CEPI/BC Mar. 12-13, 2020 meeting: Assessment of risk of disease enhancement with COVID-19 vaccines. Vaccine. Jun. 26, 2020;38(31):4783-4791. Epub May 25, 2020.

Lan et al., Tailoring subunit vaccine immunity with adjuvant combinations and delivery routes using the middle east respiratory coronavirus (MERS-CoV) receptor-binding domain as an antigen. PLoS One. Nov. 18, 2014;9(11):e112602.

Latimer et al., Specificity of monoclonal antibodies produced against phosphorothioate and ribo modified DNAs. Mol Immunol. Oct. 1995;32(14-15):1057-64.

Li et al., The epidemic of 2019-novel-coronavirus (2019-nCoV) pneumonia and insights for emerging infectious diseases in the future, Microbes Infect. Mar. 2020;22(2):80-85. doi: 10.1016/j.micinf.2020.02.002.

Lin et al., Safety and immunogenicity from a phase I trial of inactivated severe acute respiratory syndrome coronavirus vaccine. Antivir Ther. 2007;12(7):1107-13.

Luo et al., Evaluation of antibody-dependent enhancement of SARS-CoV infection in rhesus macaques immunized with an inactivated SARS-CoV vaccine. Virol Sin. Apr. 2018;33(2):201-204. Epub Mar. 14, 2018.

Maisonnasse et al., Hydroxychloroquine use against SARS-CoV-2 infection in non-human primates. Nature. Sep. 2020;585(7826):584-587. Epub Jul. 22, 2020. Supplemental Information, 14 pages.

Needleman et al., A general method applicable to the search for similarities in the amino acid sequence of two proteins. J Mol Biol. Mar. 1970;48(3):443-53.

Ng et al., Proliferative growth of SARS coronavirus in vero E6 cells. J Gen Virol. Dec. 2003;84(12):3291-3303.

Ou et al., Characterization of spike glycoprotein of SARS-CoV-2 on virus entry and its immune cross-reactivity with SARS-CoV. Nat Commun. Mar. 27, 2020;11(1):1620. Erratum in: Nat Commun. Apr. 1, 2021;12(1):2144.

Pearson et al., Improved tools for biological sequence comparison. Proc Natl Acad Sci U S A. Apr. 1988;85(8):2444-8.

Pearson W.R., Using the FASTA program to search protein and DNA sequence databases. Methods Mol Biol. 1994;25:365-89.

Pramanick et al., Excipient selection in parenteral formulation development. Pharma Times. Mar. 2013;45(3):65-77.

Rauch et al., New Vaccine Technologies to Combat Outbreak Situations. Front Immunol. Sep. 19, 2018;9:1963. doi: 10.3389/fimmu.2018.01963. 24 pages.

Roberts et al., Aged BALB/c mice as a model for increased severity of severe acute respiratory syndrome in elderly humans. J Virol. May 2005;79(9):5833-8.

Roberts et al., Animal models and vaccines for SARS-CoV infection. Virus Res. Apr. 2008;133(1):20-32. Epub May 11, 2007.

Sah et al., Complete genome sequence of a 2019 novel coronavirus (SARS-CoV-2) strain isolated in nepal. Microbiol Resour Announc. Mar. 12, 2020;9(11):e00169-20.

Schlegl et al., Influence of elemental impurities in aluminum hydroxide adjuvant on the stability of inactivated Japanese encephalitis vaccine, IXIARO®. Vaccine. Nov. 4, 2015;33(44):5989-96. Epub Jun. 19, 2015.

See et al., Severe acute respiratory syndrome vaccine efficacy in ferrets: whole killed virus and adenovirus-vectored vaccines. J Gen Virol. Sep. 2008;89(Pt 9):2136-2146.

Sekimukai et al., Gold nanoparticle-adjuvanted S protein induces a strong antigen-specific IgG response against severe acute respiratory syndrome-related coronavirus infection, but fails to induce protective antibodies and limit eosinophilic infiltration in lungs. Microbiol Immunol. Jan. 2020;64(1):33-51. Epub Nov. 18, 2019.

Shah et al., Overview of vaccine adjuvants: introduction, history, and current status. Methods Mol Biol. 2017;1494:1-13.

Shang et al., Structural basis of receptor recognition by SARS-CoV-2. Nature. May 2020;581(7807):221-224. Epub Mar. 30, 2020. Author Manuscript, 23 pages.

(56) References Cited

OTHER PUBLICATIONS

Shanmugaraj et al., Emergence of novel coronavirus 2019-nCoV: need for rapid vaccine and biologies development. Pathogens. Feb. 22, 2020;9(2):148.
She et al., Surface modifications of influenza proteins upon virus inactivation by ?-propiolactone. Proteomics. Dec. 2013;13(23-24):3537-47.
Shi et al., COVID-19 infection: the perspectives on immune responses. Cell Death Differ. May 2020;27(5):1451-1454. Epub Mar. 23, 2020.
Smith et al., Comparison of biosequences. Advances in Applied Mathematics. 1981;2(4):482-489.
Spruth et al., A double-inactivated whole virus candidate SARS coronavirus vaccine stimulates neutralising and protective antibody responses. Vaccine. Jan. 30, 2006;24(5):652-61. Epub Aug. 26, 2005.
Srivastava et al., A purified inactivated Japanese encephalitis virus vaccine made in vero cells. Vaccine. Aug. 14, 2001;19(31):4557-65.
Subbarao et al., Prior infection and passive transfer of neutralizing antibody prevent replication of severe acute respiratory syndrome coronavirus in the respiratory tract of mice. J Virol. Apr. 2004;78(7):3572-7.
Szurgot et al., DNA-launched RNA replicon vaccines induce potent anti-SARS-CoV-2 immune responses in mice. Sci Rep. Feb. 4, 2021;11(1):3125.
Tetro J.A., Is COVID-19 receiving ADE from other coronaviruses? Microbes Infect. Mar. 2020;22(2):72-73. Epub Feb. 22, 2020.
Thomas et al., Co-administration of a CpG adjuvant (VaxImmune, CPG 7909) with CETP vaccines increased immunogenicity in rabbits and mice. Hum Vaccin. Feb. 2009;5(2):79-84. Epub Mar. 1, 2009.
Tian et al., Potent binding of 2019 novel coronavirus spike protein by a SARS coronavirus-specific human monoclonal antibody. Emerg Microbes Infect. Feb. 17, 2020;9(1):382-385.
Tian et al., The novel complex combination of alum, CpG ODN and HH2 as adjuvant in cancer vaccine effectively suppresses tumor growth in vivo. Oncotarget. Jul. 11, 2017;8(28):45951-45964. doi: 10.18632/oncotarget.17504.
Tseng et al., Immunization with SARS coronavirus vaccines leads to pulmonary immunopathology on challenge with the SARS virus. PLoS One. 2012;7(4):e35421. Epub Apr. 20, 2012. Erratum in: PLoS One. 2012;7(8).
Tseng et al., Severe acute respiratory syndrome coronavirus infection of mice transgenic for the human Angiotensin-converting enzyme 2 virus receptor. J Virol. Feb. 2007;81(3):1162-73. Epub Nov. 15, 2006.
Uittenbogaard et al., Reactions of beta-propiolactone with nucleobase analogues, nucleosides, and peptides: implications for the inactivation of viruses. J Biol Chem. Oct. 21, 2011;286(42):36198-214. Epub Aug. 25, 2011.
Walls et al., Structure, function, and antigenicity of the SARS-CoV-2 spike glycoprotein. Cell. Apr. 16, 2020;181(2):281-292.e6. Epub Mar. 9, 2020. Erratum in: Cell. Dec. 10, 2020;183(6):1735.
Wan et al., Molecular mechanism for antibody-dependent enhancement of coronavirus entry. J Virol. Feb. 14, 2020;94(5):e02015-19(1-15).
Wang et al., Antibody-dependent SARS coronavirus infection is mediated by antibodies against spike proteins. Biochem Biophys Res Commun. Aug. 22, 2014;451(2):208-14. Epub Jul. 26, 2014.
Wang et al., Better adjuvants for better vaccines: progress in adjuvant delivery systems, modifications, and adjuvant-antigen codelivery. Vaccines (Basel). Mar. 13, 2020;8(1):128.
Wrapp et al., Cryo-EM structure of the 2019-nCoV spike in the prefusion conformation. Science. Mar. 13, 2020;367(6483):1260-1263. Epub Feb. 19, 2020.
Wu et al., A new coronavirus associated with human respiratory disease in China. Nature. Mar. 2020;579(7798):265-269. Epub Feb. 3, 2020. Supplemental Information, 15 pages. Erratum in: Nature. Apr. 2020;580(7803):E7.
Wu et al., Characteristics of and important lessons from the coronavirus disease 2019 (COVID-19) outbreak in China: summary of a report of 72 314 cases from the Chinese center for disease control and prevention. JAMA. Apr. 7, 2020;323(13):1239-1242.
Zeng et al., Biochemical characterization of SARS-CoV-2 nucleocapsid protein. Biochem Biophys Res Commun. Jun. 30, 2020;527(3):618-623. Epub Apr. 30, 2020.
Zhang et al., Mining of epitopes on spike protein of SARS-CoV-2 from COVID-19 patients. Cell Res. Aug. 2020;30(8):702-704. Epub Jul. 1, 2020.
Zhu et al., A novel coronavirus from patients with pneumonia in China, 2019. N Engl J Med. Feb. 20, 2020;382(8):727-733. Epub Jan. 24, 2020.
[No Author Listed], Novel Coronavirus (2019-nCOV), Situation Report 10. World Health Organization. Jan. 30, 2020. 7 pages.
Callaway, The race for coronavirus vaccines: a graphical guide. Nature. Apr. 2020;580(7805):576-577. doi: 10.1038/d41586-020-01221-y.
Gao et al., Development of an inactivated vaccine candidate for SARS-CoV-2. Science. Jul. 3, 2020;369(6499):77-81. doi: 10.1126/science.abc1932. Epub May 6, 2020.
Gao et al., Rapid development of an inactivated vaccine for SARS-CoV-2. bioRxiv. Accessible at https://www.biorxiv.org/content/10.1101/2020.04.17.046375v1. Apr. 19, 2020. doi: 10.1101/2020.04.17.046375. 29 pages.
Gupta et al., Inactivation of SARS-CoV-2 by ?-propiolactone Causes Aggregation of Viral Particles and Loss of Antigenic Potential. bioRxiv. Accessible at https://www.biorxiv.org/content/10.1101/2021.04.22.441045v1.full. Apr. 23, 2021. doi: 10.1101/2021.04.22.441045. 27 pages.
He et al., Inactivated SARS-CoV vaccine elicits high titers of spike protein-specific antibodies that block receptor binding and virus entry. Biochem Biophys Res Commun. Dec. 10, 2004;325(2):445-52. doi: 10.1016/j.bbrc.2004.10.052.
Herrera-Rodriguez et al., Inactivated or damaged? Comparing the effect of inactivation methods on influenza virions to optimize vaccine production. Vaccine. Mar. 14, 2019;37(12):1630-1637. doi: 10.1016/j.vaccine.2019.01.086. Epub Feb. 11, 2019.
Jureka et al., Propagation, Inactivation, and Safety Testing of SARS-CoV-2. Viruses. Jun. 6, 2020;12(6):622. doi: 10.3390/v12060622. 13 pages.
Rabaan et al., SARS-CoV-2/COVID-19 and advances in developing potential therapeutics and vaccines to counter this emerging pandemic. Preprints. Accessible at www.preprints.org. Apr. 7, 2020. doi: 10.20944/preprints202004.0075.v1. 46 pages.
Shang et al., The outbreak of SARS-CoV-2 pneumonia calls for viral vaccines. NPJ Vaccines. Mar. 6, 2020;5(1):18. doi: 10.1038/s41541-020-0170-0. 3 pages.
Arunachalam et al., Adjuvanting a subunit COVID-19 vaccine to induce protective immunity. Nature. Jun. 2021;594(7862):253-258. doi: 10.1038/s41586-021-03530-2. Epub Apr. 19, 2021.
Chen et al., Structure analysis of the receptor binding of 2019-nCoV. Biochem Biophys Res Commun. Feb. 17, 2020;525(1):135-40. doi: 10.1016/j.bbrc.2020.02.071. Epub ahead of print.
Du et al., The spike protein of SARS-CoV—a target for vaccine and therapeutic development. Nat Rev Microbiol. Mar. 2009;7(3):226-36. doi: 10.1038/nrmicro2090. Epub Feb. 9, 2009.
Graham et al., A decade after SARS: strategies for controlling emerging coronaviruses. Nat Rev Microbiol. Dec. 2013;11(12):836-48. doi: 10.1038/nrmicro3143. Epub Nov. 11, 2013.
Kuo et al., Development of CpG-adjuvanted stable prefusion SARS-CoV-2 spike antigen as a subunit vaccine against COVID-19. Sci Rep. Nov. 18, 2020;10(1):20085. doi: 10.1038/s41598-020-77077-z. 10 pages.
Letko et al., Functional assessment of cell entry and receptor usage for SARS-CoV-2 and other lineage B betacoronaviruses. Nat Microbiol. Apr. 2020;5(4):562-569. doi: 10.1038/s41564-020-0688-y. Epub Feb. 24, 2020.
Liang et al., S-Trimer, a COVID-19 subunit vaccine candidate, induces protective immunity in nonhuman primates. Nat Commun. Mar. 1, 2021;12(1):1346. doi: 10.1038/s41467-021-21634-1. 12 pages.

(56) References Cited

OTHER PUBLICATIONS

Lien et al., CpG-adjuvanted stable prefusion SARS-CoV-2 spike protein protected hamsters from SARS-CoV-2 challenge. Sci Rep. Apr. 22, 2021;11(1):8761. doi: 10.1038/s41598-021-88283-8. 7 pages.

Petrovsky, Chapter 3: SARS Coronavirus Infections of the Lower Respiratory Tract and Their Prevention. The Microbiology of Respiratory System Infections, doi: 10.116/B978-0-12-804543-5.00003-8. 2016:45-53.

Ragan et al., A Whole Virion Vaccine for COVID-19 Produced via a Novel Inactivation Method and Preliminary Demonstration of Efficacy in an Animal Challenge Model. Vaccines (Basel). Apr. 1, 2021;9(4):340. doi: 10.3390/vaccines9040340.

Richmond et al., Safety and immunogenicity of S-Trimer (SCB-2019), a protein subunit vaccine candidate for COVID-19 in healthy adults: a phase 1, randomised, double-blind, placebo-controlled trial. Lancet. Feb. 20, 2021;397(10275):682-694. doi: 10.1016/S0140-6736(21)00241-5. Epub Jan. 29, 2021.

Zhou et al., A pneumonia outbreak associated with a new coronavirus of probable bat origin. Nature. Mar. 2020;579(7798):270-273. doi: 10.1038/s41586-020-2012-7. Epub Feb. 3, 2020.

[No Author Listed], Valneva Receives Marketing Authorization in Europe for Inactivated Whole-Virus COVID-19 Vaccine VLA2001. Valneva Press Release. Jun. 24, 2022. 2 pages.

\* cited by examiner

| Isolate | GenBank accession number** | | | Locality |
|---|---|---|---|---|
| | Genome | orf1ab polyprotein | s protein | |
| Severe acute respiratory syndrome coronavirus 2* | MN908947 (SEQ ID NO: 1) | QHD43415 (SEQ ID NO: 2) | QHD43416 (SEQ ID NO: 3) | China |
| SARS-CoV-2/Hu/DP/Kng/19-020 | LC528232 | BCA87360 | BCA87361 | Japan |
| SARS-CoV-2/Hu/DP/Kng/19-027 | LC528233 | BCA87370 | BCA87371 | Japan |
| TKYE6182_2020 | LC529905 | BCB15089 | BCB15090 | Japan |
| From Wuhan outbreak patient 2019-12-26 | LR757995 | - | - | China:Wuhan |
| From Wuhan outbreak patient 2020-01-01 | LR757996 | - | - | China:Wuhan |
| From Wuhan outbreak patent 2019-12-26 | LR757998 | - | - | China:Wuhan |
| 2019-nCoV_HKU-SZ-002a_2020 | MN938384 | QHN73794 | QHN73795 | China:Shenzhen |
| 2019-nCoV_HKU-SZ-005b_2020 | MN975262 | QHN73809 | QHN73810 | China |
| 2019-nCoV/USA-WA1/2020 | MN985325 | QHO60603 | QHO60594 | USA:WA |
| 2019-nCoV/WHU01 | MN988668 | QHO62106 | QHO62107 | China |
| 2019-nCoV/WHU02 | MN988669 | QHO62111 | QHO62112 | China |
| 2019-nCoV/USA-IL1/2020 | MN988713 | QHO62876 | QHO62877 | USA:IL |
| 2019-nCoV/USA-CA1/2020 | MN994467 | QHQ71962 | QHQ71963 | USA:CA |
| 2019-nCoV/USA-CA2/2020 | MN994468 | QHQ71972 | QHQ71973 | USA:CA |
| WIV02 | MN996527 | QHR63249 | QHR63250 | China:Wuhan |
| WIV04 | MN996528 | QHR63259 | QHR63260 | China:Wuhan |
| WIV05 | MN996529 | QHR63269 | QHR63270 | China:Wuhan |
| WIV06 | MN996530 | QHR63279 | QHR63280 | China:Wuhan |
| WIV07 | MN996531 | QHR63289 | QHR63290 | China:Wuhan |
| 2019-nCoV/USA-AZ1/2020 | MN997409 | QHQ82463 | QHQ82464 | USA:AZ |
| Australia/VIC01/2020 | MT007544 | QHR84448 | QHR84449 | Australia:Victoria |
| SARS-CoV-2/29/human/2020/IND | MT012098 | QHS34545 | QHS34546 | India:Kerala State |

FIG. 2A

| Isolate | GenBank accession number** | | | Locality |
|---|---|---|---|---|
| | Genome | orf1ab polyprotein | s protein | |
| BetaCoV/Wuhan/IPBCAMS-WH-01/2019 | MT019529 | QHU36823 | QHU36824 | China:Wuhan |
| BetaCoV/Wuhan/IPBCAMS-WH-02/2019 | MT019530 | QHU36833 | QHU36834 | China:Wuhan |
| BetaCoV/Wuhan/IPBCAMS-WH-03/2019 | MT019531 | QHU36843 | QHU36844 | China:Wuhan |
| BetaCoV/Wuhan/IPBCAMS-WH-04/2019 | MT019532 | QHU36853 | QHU36854 | China:Wuhan |
| BetaCoV/Wuhan/IPBCAMS-WH-05/2020 | MT019533 | QHU36863 | QHU36864 | China:Wuhan |
| 2019-nCoV/USA-WA1-A12/2020 | MT020880 | QHU79193 | QHU79194 | USA:WA |
| 2019-nCoV/USA-WA1-F6/2020 | MT020881 | QHU79203 | QHU79204 | USA:WA |
| 2019-nCoV/USA-CA3/2020 | MT027062 | QHM06038 | QHM06039 | USA:CA |
| 2019-nCoV/USA-CA4/2020 | MT027063 | QHM06048 | QHM06049 | USA:CA |
| 2019-nCoV/USA-CA5/2020 | MT027064 | QHM06058 | QHM06059 | USA:CA |
| HZ-1 | MT039873 | QHZ00357 | QHZ00358 | China:Hangzhou |
| 2019-nCoV/USA-WI1/2020 | MT039887 | QHZ00388 | QHZ00389 | USA:WI |
| 2019-nCoV/USA-MA1/2020 | MT039888 | QHZ00398 | QHZ00399 | USA:MA |
| SNU01 | MT039890 | QHZ00378 | QHZ00379 | South Korea |
| 2019-nCoV/USA-CA6/2020 | MT044258 | QHZ87591 | QHZ87592 | USA:CA |
| SARS-CoV-2/Yunnan-01/human/2020/CHN | MT049951 | QIA20042 | QIA20043 | China:Yunnan |
| SARS-CoV-2/166/human/2020/IND | MT050493 | QIA98582 | QIA98583 | India:Kerala State |
| SARS-CoV-2/INMI1/human/2020/ITA | MT066156 | QIA98553 | QIA98554 | Italy |
| SARS-CoV-2/NTU01/2020/TWN | MT066175 | QIA98595 | QIA98596 | Taiwan |
| SARS-CoV-2/NTU02/2020/TWN | MT066176 | QIA98605 | QIA98606 | Taiwan |
| SARS-CoV-2/01/human/2020/SWE | MT093571 | QIC53203 | QIC53204 | Sweden |
| SARS-CoV-2/WH-09/human/2020/CHN | MT093631 | QIC53222 | QIC53213 | China |
| 2019-nCoV/USA-CA7/2020 | MT106052 | QID21047 | QID21048 | USA:CA |

FIG. 2B

| Isolate | GenBank accession number** | | | Locality |
|---|---|---|---|---|
| | Genome | orf1ab polyprotein | s protein | |
| 2019-nCoV/USA-CA8/2020 | MT106053 | QID21057 | QID21058 | USA:CA |
| 2019-nCoV/USA-TX1/2020 | MT106054 | QID21067 | QID21068 | USA:TX |
| 2019-nCoV/USA-CA9/2020 | MT118835 | QID98793 | QID98794 | USA:CA |
| SARS-CoV-2/SH01/human/2020/CHN | MT121215 | QII57165 | QII57161 | China:Shanghai |
| SARS-CoV-2/IQTC01/human/2020/CHN | MT123290 | QIE07450 | QIE07451 | China:Guangzhou |
| SARS-CoV-2/IQTC02/human/2020/CHN | MT123291 | QIE07460 | QIE07461 | China:Guangzhou |
| SARS-CoV-2/IQTC04/human/2020/CHN | MT123292 | QIE07470 | QIE07471 | China:Guangzhou |
| SARS-CoV-2/IQTC03/human/2020/CHN | MT123293 | QIE07480 | QIE07481 | China:Guangzhou |
| SARS-CoV-2/SP02/human/2020/BRA | MT126808 | QIG55993 | QIG55994 | Brazil |
| SARS-CoV-2/105/human/2020/CHN | MT135041 | QIH45022 | QIH45023 | China:Beijing |
| SARS-CoV-2/231/human/2020/CHN | MT135042 | QIH45032 | QIH45033 | China:Beijing |
| SARS-CoV-2/233/human/2020/CHN | MT135043 | QIH45042 | QIH45043 | China:Beijing |
| SARS-CoV-2/235/human/2020/CHN | MT135044 | QIH45052 | QIH45053 | China:Beijing |
| SARS-CoV-2/WA2/human/2020/USA | MT152824 | QIH65220 | QIH65221 | USA:WA |
| 2019-nCoV/USA-CruiseA-7/2020 | MT159705 | QII57167 | QII57168 | USA |
| 2019-nCoV/USA-CruiseA-8/2020 | MT159706 | QII57177 | QII57178 | USA |
| 2019-nCoV/USA-CruiseA-10/2020 | MT159707 | QII57187 | QII57188 | USA |
| 2019-nCoV/USA-CruiseA-11/2020 | MT159708 | QII57197 | QII57198 | USA |
| 2019-nCoV/USA-CruiseA-12/2020 | MT159709 | QII57207 | QII57208 | USA |
| 2019-nCoV/USA-CruiseA-9/2020 | MT159710 | QII57217 | QII57218 | USA |
| 2019-nCoV/USA-CruiseA-13/2020 | MT159711 | QII57227 | QII57228 | USA |
| 2019-nCoV/USA-CruiseA-14/2020 | MT159712 | QII57237 | QII57238 | USA |
| 2019-nCoV/USA-CruiseA-15/2020 | MT159713 | QII57247 | QII57248 | USA |

FIG. 2C

| isolate | GenBank accession number** | | | Locality |
|---|---|---|---|---|
| | Genome | orf1ab polyprotein | s protein | |
| 2019-nCoV/USA-CruiseA-16/2020 | MT159714 | QII57257 | QII57258 | USA |
| 2019-nCoV/USA-CruiseA-17/2020 | MT159715 | QII57267 | QII57268 | USA |
| 2019-nCoV/USA-CruiseA-18/2020 | MT159716 | QII57277 | QII57278 | USA |
| 2019-nCoV/USA-CruiseA-1/2020 | MT159717 | QII57287 | QII57288 | USA |
| 2019-nCoV/USA-CruiseA-2/2020 | MT159718 | QII57297 | QII57297 | USA |
| 2019-nCoV/USA-CruiseA-3/2020 | MT159719 | QII57307 | QII57308 | USA |
| 2019-nCoV/USA-CruiseA-4/2020 | MT159720 | QII57317 | QII57318 | USA |
| 2019-nCoV/USA-CruiseA-5/2020 | MT159721 | QII57327 | QII57328 | USA |
| 2019-nCoV/USA-CruiseA-6/2020 | MT159722 | QII57337 | QII57338 | USA |
| SARS-CoV-2/WA3-UW1/human/2020/USA | MT163716 | QII87780 | QII87781 | USA/WA |
| SARS-CoV-2/WA4-UW2/human/2020/USA | MT163717 | QII87792 | QII87793 | USA/WA |
| SARS-CoV-2/WA6-UW3/human/2020/USA | MT163718 | QII87804 | QII87805 | USA/WA |
| SARS-CoV-2/WA7-UW4/human/2020/USA | MT163719 | QII87816 | QII87817 | USA/WA |
| 2019-nCoV/USA-CruiseA-19/2020 | MT184907 | QIJ96462 | QIJ96463 | USA |
| 2019-nCoV/USA-CruiseA-21/2020 | MT184908 | QIJ96472 | QIJ96473 | USA |
| 2019-nCoV/USA-CruiseA-22/2020 | MT184909 | QIJ96482 | QIJ96483 | USA |
| 2019-nCoV/USA-CruiseA-23/2020 | MT184910 | QIJ96492 | QIJ96493 | USA |
| 2019-nCoV/USA-CruiseA-24/2020 | MT184911 | QIJ96502 | QIJ96503 | USA |
| 2019-nCoV/USA-CruiseA-25/2020 | MT184912 | QIJ96512 | QIJ96513 | USA |
| 2019-nCoV/USA-CruiseA-26/2020 | MT184913 | QIJ96522 | QIJ96523 | USA |
| USA/MN3-MDH3/2020 | MT188339 | QIK02943 | QIK02944 | USA/MN |
| USA/MN2-MDH2/2020 | MT188340 | QIK02953 | QIK02954 | USA/MN |
| USA/MN1-MDH1/2020 | MT188341 | QIK02963 | QIK02964 | USA/MN |

FIG. 2D

| Isolate | GenBank accession number** | | | Locality |
|---|---|---|---|---|
| | Genome | orf1ab polyprotein | s protein | |
| SARS-CoV-2/CGMH-CGU-01/human/2020/TWN | MT192759 | QIK50416 | QIK50417 | Taiwan |
| SARS-CoV-2/PC00101P/human/2020/USA | MT192765 | QIK50426 | QIK50427 | USA:CA |
| SARS-CoV-2/nCoV-19-01S/human/2020/VNM | MT192772 | QIK50437 | QIK50438 | Vietnam:Ho Chi Minh City |
| SARS-CoV-2/nCoV-19-02S/human/2020/VNM | MT192773 | QIK50447 | QIK50448 | Vietnam:Ho Chi Minh City |
| SARS-CoV-2/KMS1/human/2020/CHN | MT226610 | QIO04366 | QIO04367 | China |
| SARS-CoV-2/Valencia5/human/2020/ESP | MT233519 | QIO08789 | QIO08790 | Spain:Valencia |
| SARS-CoV-2/Valencia7/human/2020/ESP | MT233522 | QIO08819 | QIO08820 | Spain:Valencia |
| SARS-CoV-2/Valencia8/human/2020/ESP | MT233523 | QIO08829 | QIO08830 | Spain:Valencia |
| SARS-CoV-2/Gilgit1/human/2020/PAK | MT240479 | QIQ22758 | QIQ22759 | Pakistan:Gilgit |
| SARS-CoV-2/WA-UW192/human/2020/USA | MT246449 | QIQ49761 | QIQ49762 | USA:WA |
| SARS-CoV-2/WA-UW193/human/2020/USA | MT246450 | QIQ49771 | QIQ49772 | USA:WA |
| SARS-CoV-2/WA-UW194/human/2020/USA | MT246451 | QIQ49781 | QIQ49782 | USA:WA |
| SARS-CoV-2/WA-UW195/human/2020/USA | MT246452 | QIQ49791 | QIQ49792 | USA:WA |
| SARS-CoV-2/WA-UW196/human/2020/USA | MT246453 | QIQ49801 | QIQ49802 | USA:WA |
| SARS-CoV-2/WA-UW197/human/2020/USA | MT246454 | QIQ49811 | QIQ49812 | USA:WA |
| SARS-CoV-2/WA-UW198/human/2020/USA | MT246455 | QIQ49821 | QIQ49822 | USA:WA |
| SARS-CoV-2/WA-UW199/human/2020/USA | MT246456 | QIQ49831 | QIQ49832 | USA:WA |
| SARS-CoV-2/WA-UW200/human/2020/USA | MT246457 | QIQ49841 | QIQ49842 | USA:WA |
| SARS-CoV-2/WA-UW201/human/2020/USA | MT246458 | QIQ49851 | QIQ49852 | USA:WA |
| SARS-CoV-2/WA-UW202/human/2020/USA | MT246459 | QIQ49861 | QIQ49862 | USA:WA |
| SARS-CoV-2/WA-UW203/human/2020/USA | MT246460 | QIQ49871 | QIQ49872 | USA:WA |
| SARS-CoV-2/WA-UW204/human/2020/USA | MT246461 | QIQ49881 | QIQ49882 | USA:WA |
| SARS-CoV-2/WA-UW205/human/2020/USA | MT246462 | QIQ49891 | QIQ49892 | USA:WA |

FIG. 2E

| Isolate | GenBank accession number*** | | | Locality |
|---|---|---|---|---|
| | Genome | orf1ab polyprotein | s protein | |
| SARS-CoV-2/WA-UW207/human/2020/USA | MT246464 | QIQ49911 | QIQ49912 | USA:WA |
| SARS-CoV-2/WA-UW209/human/2020/USA | MT246466 | QIQ49931 | QIQ49932 | USA:WA |
| SARS-CoV-2/WA-UW210/human/2020/USA | MT246467 | QIQ49941 | QIQ49942 | USA:WA |
| SARS-CoV-2/WA-UW211/human/2020/USA | MT246468 | QIQ49951 | QIQ49952 | USA:WA |
| SARS-CoV-2/WA-UW212/human/2020/USA | MT246469 | QIQ49961 | QIQ49962 | USA:WA |
| SARS-CoV-2/WA-UW213/human/2020/USA | MT246470 | QIQ49971 | QIQ49972 | USA:WA |
| SARS-CoV-2/WA-UW214/human/2020/USA | MT246471 | QIQ49981 | QIQ49982 | USA:WA |
| SARS-CoV-2/WA-UW215/human/2020/USA | MT246472 | QIQ49991 | QIQ49992 | USA:WA |
| SARS-CoV-2/WA-UW216/human/2020/USA | MT246473 | QIQ50001 | QIQ50002 | USA:WA |
| SARS-CoV-2/WA-UW217/human/2020/USA | MT246474 | QIQ50011 | QIQ50012 | USA:WA |
| SARS-CoV-2/WA-UW218/human/2020/USA | MT246475 | QIQ50021 | QIQ50022 | USA:WA |
| SARS-CoV-2/WA-UW219/human/2020/USA | MT246476 | QIQ50031 | QIQ50032 | USA:WA |
| SARS-CoV-2/WA-UW220/human/2020/USA | MT246477 | QIQ50041 | QIQ50042 | USA:WA |
| SARS-CoV-2/WA-UW221/human/2020/USA | MT246478 | QIQ50051 | QIQ50052 | USA:WA |
| SARS-CoV-2/WA-UW222/human/2020/USA | MT246479 | QIQ50061 | QIQ50062 | USA:WA |
| SARS-CoV-2/WA-UW223/human/2020/USA | MT246480 | QIQ50071 | QIQ50072 | USA:WA |
| SARS-CoV-2/WA-UW224/human/2020/USA | MT246481 | QIQ50081 | QIQ50082 | USA:WA |
| SARS-CoV-2/WA-UW225/human/2020/USA | MT246482 | QIQ50091 | QIQ50092 | USA:WA |
| SARS-CoV-2/WA-UW227/human/2020/USA | MT246484 | QIQ50111 | QIQ50112 | USA:WA |
| SARS-CoV-2/WA-UW228/human/2020/USA | MT246485 | QIQ50121 | QIQ50122 | USA:WA |
| SARS-CoV-2/WA-UW229/human/2020/USA | MT246486 | QIQ50131 | QIQ50132 | USA:WA |
| SARS-CoV-2/WA-UW230/human/2020/USA | MT246487 | QIQ50141 | QIQ50142 | USA:WA |
| SARS-CoV-2/WA-UW231/human/2020/USA | MT246488 | QIQ50151 | QIQ50152 | USA:WA |

FIG. 2F

| Isolate | GenBank accession number** | | | Locality |
|---|---|---|---|---|
| | Genome | orf1ab polyprotein | s protein | |
| SARS-CoV-2/WA-UW232/human/2020/USA | MT246489 | QIQ50161 | QIQ50162 | USA:WA |
| SARS-CoV-2/WA-UW233/human/2020/USA | MT246490 | QIQ50171 | QIQ50172 | USA:WA |
| SARS-CoV-2/WA-UW236/human/2020/USA | MT251972 | QIQ68463 | QIQ68464 | USA:WA |
| SARS-CoV-2/WA-UW237/human/2020/USA | MT251973 | QIQ68473 | QIQ68474 | USA:WA |
| SARS-CoV-2/WA-UW238/human/2020/USA | MT251974 | QIQ68483 | QIQ68484 | USA:WA |
| SARS-CoV-2/WA-UW239/human/2020/USA | MT251975 | QIQ68493 | QIQ68494 | USA:WA |
| SARS-CoV-2/WA-UW240/human/2020/USA | MT251976 | QIQ68503 | QIQ68504 | USA:WA |
| SARS-CoV-2/WA-UW234/human/2020/USA | MT251977 | QIQ68513 | QIQ68514 | USA:WA |
| SARS-CoV-2/WA-UW235/human/2020/USA | MT251978 | QIQ68523 | QIQ68524 | USA:WA |
| SARS-CoV-2/WA-UW241/human/2020/USA | MT251979 | QIQ68533 | QIQ68534 | USA:WA |
| SARS-CoV-2/WA-UW242/human/2020/USA | MT251980 | QIQ68543 | QIQ68544 | USA:WA |
| SARS-CoV-2/HZ-162/human/2020/CHN | MT253696 | QIQ68553 | QIQ68554 | China:Hangzhou |
| SARS-CoV-2/HZ-178/human/2020/CHN | MT253697 | QIQ68563 | QIQ68564 | China:Hangzhou |
| SARS-CoV-2/HZ-185/human/2020/CHN | MT253698 | QIQ68573 | QIQ68574 | China:Hangzhou |
| SARS-CoV-2/HZ-477/human/2020/CHN | MT253699 | QIQ68583 | QIQ68584 | China:Hangzhou |
| SARS-CoV-2/HZ-481/human/2020/CHN | MT253700 | QIQ68593 | QIQ68594 | China:Hangzhou |
| SARS-CoV-2/HZ-48/human/2020/CHN | MT253701 | QIQ68603 | QIQ68604 | China:Hangzhou |
| SARS-CoV-2/HZ-49/human/2020/CHN | MT253702 | QIQ68613 | QIQ68614 | China:Hangzhou |
| SARS-CoV-2/HZ-551/human/2020/CHN | MT253703 | QIQ68623 | QIQ68624 | China:Hangzhou |
| SARS-CoV-2/HZ-576/human/2020/CHN | MT253704 | QIQ68633 | QIQ68634 | China:Hangzhou |
| SARS-CoV-2/HZ-60/human/2020/CHN | MT253705 | QIQ68643 | QIQ68644 | China:Hangzhou |
| SARS-CoV-2/HZ-62/human/2020/CHN | MT253706 | QIQ68653 | QIQ68654 | China:Hangzhou |
| SARS-CoV-2/HZ-638/human/2020/CHN | MT253707 | QIQ68663 | QIQ68664 | China:Hangzhou |

FIG. 2G

| Isolate | GenBank accession number** | | | Locality |
|---|---|---|---|---|
| | Genome | orf1ab polyprotein | s protein | |
| SARS-CoV-2/HZ-79/human/2020/CHN | MT253708 | QIQ68673 | QIQ68674 | China:Hangzhou |
| SARS-CoV-2/HZ-90/human/2020/CHN | MT253709 | QIQ68683 | QIQ68684 | China:Hangzhou |
| SARS-CoV-2/HZ-91/human/2020/CHN | MT253710 | QIQ68693 | QIQ68694 | China:Hangzhou |
| Severe acute respiratory syndrome coronavirus 2 isolate SARS-CoV-2/human/England/ex-SA/2021, EVAg Ref-SKU:004V-04071 (SA_P2) complete genome. South-African B.1.351 lineage | SA_P2_t0.9_q20 (SEQ ID NO: 18) | | SA_P2_gp02 (SEQ ID NO: 19) | UK |
| Severe acute respiratory syndrome coronavirus 2 isolate SARS-CoV-2/human/GHA/n-mimr-SARS-CoV-2-TRA-143/2021, complete genome. South-African B.1.351 lineage | MW598408.1 | | QRN78215.1 | Ghana |
| Severe acute respiratory syndrome coronavirus 2 isolate SARS-CoV-2/human/GHA/n-mimr-SARS-CoV-2-TRA-186/2021, complete genome. South-African B.1.351 lineage | MW598413.1 | | QRN78275.1 | Ghana |
| Severe acute respiratory syndrome coronavirus 2 isolate SARS-CoV-2/human/GHA/n-mimr-SARS-CoV-2-TRA-201/2021, complete genome. South-African B.1.351 lineage | MW598419.1 | | QRN78347.1 | Ghana |

FIG. 2H

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human/USA/MA-Broad_CR-SP-00844/2021, complete genome, South-African B.1.351 lineage | MW617734.1 | | QRU93410.1 | USA |
| Severe acute respiratory syndrome coronavirus 2 isolate SARS-CoV-2/human/USA/MD-MDH-0862/2021, complete genome, South-African B.1.351 lineage | MW621453.1 | | QRV12312.1 | USA |
| Severe acute respiratory syndrome coronavirus 2 isolate SARS-CoV-2/human/USA/SC-COV-ID21-0037/2021 ORF1ab polyprotein (ORF1ab) gene, complete cds; ORF1a polyprotein (ORF1ab) gene, partial cds; surface glycoprotein (S), ORF3a protein (ORF3a), and envelope protein (E) genes, complete cds; membrane glycoprotein (M) and ORF7b (ORF7b) genes, partial cds; and ORF8 protein (ORF8), nucleocapsid phosphoprotein (N), and ORF10 protein (ORF10) genes, complete cds, South-African B.1.351 lineage | MW517347.1 | | QQW56090.1 | USA |

FIG. 21

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human /USA/SC-CDC-LC0003421/2021 ORF1ab polyprotein (ORF1ab) gene, complete cds; ORF1a polyprotein (ORF1ab) gene, partial cds; surface glycoprotein (S), ORF3a protein (ORF3a), envelope protein (E), membrane glycoprotein (M), ORF6 protein (ORF6), and ORF7a protein (ORF7a) genes, complete cds; ORF7b (ORF7b) and nucleocapsid phosphoprotein (N) genes, partial cds; and ORF10 protein (ORF10) gene, complete cds. South-African B.1.351 lineage | MW548962.1 | | QRA20125.1 | USA |
| Severe acute respiratory syndrome coronavirus 2 isolate SARS-CoV-2/human/GHA/WACCBIP_nCoV-_GS73/2021 ORF1ab polyprotein (ORF1ab), ORF1a polyprotein (ORF1ab), surface glycoprotein (S), ORF3a protein (ORF3a), envelope protein (E), membrane glycoprotein (M), ORF6 protein (ORF6), ORF7a protein (ORF7a), ORF7b (ORF7b), ORF8 protein (ORF8), nucleocapsid phosphoprotein (N), and ORF10 protein (ORF10) genes, complete cds. South-African B.1.351 lineage | MW571126.1 | | QRG27673.1 | Ghana |

FIG. 2J

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human/USA/MD-MDH-0830/2021 ORF1ab polyprotein (ORF1ab), ORF1a polyprotein (ORF1ab), surface glycoprotein (S), ORF3a protein (ORF3a), envelope protein (E), membrane glycoprotein (M), ORF6 protein (ORF6), ORF7a protein (ORF7a), ORF7b (ORF7b), ORF8 protein (ORF8), nucleocapsid phosphoprotein (N), and ORF10 protein (ORF10) genes, complete cds. South-African B.1.351 lineage | MW580573.1 | | QRI43422.1 | USA |
| Severe acute respiratory syndrome coronavirus 2 isolate SARS-CoV-2/human /USA/MD-MDH-0831/2021, complete genome. South-African B.1.351 lineage | MW580574.1 | | QRI43434.1 | USA |
| Severe acute respiratory syndrome coronavirus 2 isolate SARS-CoV-2/human /USA/MD-MDH-0833/2021, complete genome. South-African B.1.351 lineage | MW580576.1 | | QRI43458.1 | USA |
| Severe acute respiratory syndrome coronavirus 2 isolate SARS-CoV-2/human/USA/MN-MDH-2399/2021, complete genome. Brazilian P1 lineage | MW520923.1 (SEQ ID NO: 20) | | QQX12069.1 (SEQ ID NO: 21) | USA |

FIG. 2K

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human /USA/MN-MDH-2575/2021, complete genome. Brazilian P1 lineage | MW558281.1 | | QRD95445.1 | USA |
| Severe acute respiratory syndrome coronavirus 2 isolate SARS-CoV-2/human/USA/OK-USAF-SAM-S0004/2021 ORF1ab polyprotein (ORF1ab), ORF1a polyprotein (ORF1ab), surface glycoprotein (S), ORF3a protein (ORF3a), envelope protein (E), membrane glycoprotein (M), ORF6 protein (ORF6), ORF7a protein (ORF7a), ORF7b (ORF7b), ORF8 protein (ORF8), nucleocapsid phosphoprotein (N), and ORF10 protein (ORF10) genes, complete cds. Brazilian P1 lineage | MW559120.1 | | QRE01802.1 | USA |
| Severe acute respiratory syndrome coronavirus 2 isolate SARS-CoV-2/human /USA/MD-MDH-0841/2021, complete genome. Brazilian P1 lineage | MW621433.1 | | QRV12072.1 | USA |

FIG. 2L

| Isolate | GenBank accession number** | | Locality |
|---|---|---|---|
| | Genome | orf1ab polyprotein / s protein | |

| Isolate | Genome | s protein | Locality |
|---|---|---|---|
| Severe acute respiratory syndrome coronavirus 2 isolate SARS-CoV-2/human/England/MIG457/2020, EVAg Ref-S

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human /USA/MN-MDH-2416/2021, complete genome. UK B 1.1.7 lineage | MW520940.1 | | QQX12273.1 | USA |
| Severe acute respiratory syndrome coronavirus 2 isolate SARS-CoV-2/human/USA/-CA-CDC-STM-A100377/2021, complete genome. UK B 1.1.7 lineage | MW523787.1 | | QQX30401.1 | USA |
| Severe acute respiratory syndrome coronavirus 2 isolate SARS-CoV-2/human/USA/-FL-CDC-STM-0000013-F08/2021, complete genome. UK B 1.1.7 lineage | MW524888.1 | | QQX33678.1 | USA |
| Severe acute respiratory syndrome coronavirus 2 isolate SARS-CoV-2/human/USA/-CA-CDC-STM-0000025-C04/2021, complete genome. UK B 1.1.7 lineage | MW525027.1 | | QQX35346.1 | USA |
| Severe acute respiratory syndrome coronavirus 2 isolate SARS-CoV-2/human /USA/MI-CDC-STM-0000013-E10/2021, complete genome. UK B 1.1.7 lineage | MW525061.1 | | QQX35754.1 | USA |

FIG. 2N

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human /USA/MN-CDC-STM-000013-A10/2021, complete genome. UK B 1.1.7 lineage | MW525074.1 | | QQX35910.1 | USA |
| Severe acute respiratory syndrome coronavirus 2 isolate SARS-CoV-2/human/BGD/G039392/2021, complete genome. UK B 1.1.7 lineage | MW531680.1 | | QQX99439.1 | Bangladesh |
| Severe acute respiratory syndrome coronavirus 2 isolate SARS-CoV-2/human /USA/MN-MDH-2501/2021, complete genome. UK B 1.1.7 lineage | MW549866.1 | | QRA60361.1 | USA |
| Severe acute respiratory syndrome coronavirus 2 isolate SARS-CoV-2/human/USA/ CA-QDX-4373/2021, complete genome. UK B 1.1.7 lineage | MW560781.1 | | QRF68655.1 | USA |
| Severe acute respiratory syndrome coronavirus 2 isolate SARS-CoV-2/human/USA/MD-MDH-0745/2021, complete genome. UK B 1.1.7 lineage | MW565850.1 | | QRG21605.1 | USA |

FIG. 20

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human /USA/MD-MDH-0749/2021, complete genome. UK B 1.1.7 lineage | MW565853.1 | | QRG21641.1 | USA |
| Severe acute respiratory syndrome coronavirus 2 isolate SARS-CoV-2/human /USA/MD-MDH-0750/2021, complete genome. UK B 1.1.7 lineage | MW565854.1 | | QRG21653.1 | USA |
| Severe acute respiratory syndrome coronavirus 2 isolate SARS-CoV-2/human /USA/MD-MDH-0751/2021, complete genome. UK B 1.1.7 lineage | MW565855.1 | | QRG21665.1 | USA |
| Severe acute respiratory syndrome coronavirus 2 isolate SARS-CoV-2/human /USA/MD-MDH-0814/2021, complete genome. UK B 1.1.7 lineage | MW580558.1 | | QRI43243.1 | USA |
| Severe acute respiratory syndrome coronavirus 2 isolate SARS-CoV-2/human /USA/MD-MDH-0815/2021, complete genome. UK B 1.1.7 lineage | MW580559.1 | | QRI43255.1 | USA |

FIG. 2P

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human /USA/MD-MDH-0817/2021, complete genome. UK B 1.1.7 lineage | MW580561.1 | | QRI43279.1 | USA |
| Severe acute respiratory syndrome coronavirus 2 isolate SARS-CoV-2/human/USA/OH-UHTL-2/2020, complete genome. UK B 1.1.7 lineage | MW584988.1 | | QRJ69803.1 | USA |
| Severe acute respiratory syndrome coronavirus 2 isolate SARS-CoV-2/human/USA/-CA-CDC-STM-000002976/2021, complete genome. UK B 1.1.7 lineage | MW586592.1 | | QRK23526.1 | USA |
| Severe acute respiratory syndrome coronavirus 2 isolate SARS-CoV-2/human/USA/-CA-CDC-STM-000002933/2021, complete genome. UK B 1.1.7 lineage | MW586593.1 | | QRK23538.1 | USA |
| Severe acute respiratory syndrome coronavirus 2 isolate SARS-CoV-2/hu-man/USA/NC-CDC-STM-000002954/2021, complete genome. UK B 1.1.7 lineage | MW586597.1 | | QRK23586.1 | USA |

FIG. 2Q

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human/USA/-FL-CDC-STM-000003054/2021, complete genome. UK B 1.1.7 lineage | MW586603.1 | | QRK23658.1 | USA |
| Severe acute respiratory syndrome coronavirus 2 isolate SARS-CoV-2/human/USA/-FL-CDC-STM-000003073/2021, complete genome. UK B 1.1.7 lineage | MW586613.1 | | QRK23778.1 | USA |
| Severe acute respiratory syndrome coronavirus 2 isolate SARS-CoV-2/hu-man/USA/NJ-CDC-STM-000003010/2021, complete genome. UK B 1.1.7 lineage | MW586623.1 | | QRK23898.1 | USA |
| Severe acute respiratory syndrome coronavirus 2 isolate SARS-CoV-2/human/USA/-FL-CDC-STM-000003618/2021, complete genome. UK B 1.1.7 lineage | MW586670.1 | | QRK24462.1 | USA |
| Severe acute respiratory syndrome coronavirus 2 isolate SARS-CoV-2/human/USA/-FL-CDC-STM-000003556/2021, complete genome. UK B 1.1.7 lineage | MW586671.1 | | QRK24474.1 | USA |

FIG. 2R

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human/USA/FL-CDC-STM-000003509/2021, complete genome. UK B 1.1.7 lineage | MW586673.1 | | QRK24498.1 | USA |
| Severe acute respiratory syndrome coronavirus 2 isolate SARS-CoV-2/human/USA/FL-CDC-STM-000003537/2021, complete genome. UK B 1.1.7 lineage | MW586679.1 | | QRK24570.1 | USA |
| Severe acute respiratory syndrome coronavirus 2 isolate SARS-CoV-2/human/USA/FL-CDC-STM-000003592/2021, complete genome. UK B 1.1.7 lineage | MW586680.1 | | QRK24582.1 | USA |
| Severe acute respiratory syndrome coronavirus 2 isolate SARS-CoV-2/human/USA/FL-CDC-STM-000003574/2021, complete genome. UK B 1.1.7 lineage | MW586681.1 | | QRK24594.1 | USA |
| Severe acute respiratory syndrome coronavirus 2 isolate SARS-CoV-2/human/USA/CA-LACPHL-AF00368/2021, complete genome. UK B 1.1.7 lineage | MW587778.1 | | QRL06527.1 | USA |

FIG. 2S

| Isolate | GenBank accession number** | | | Locality |
|---|---|---|---|---|
| | Genome | orf1ab polyprotein | s protein | |
| Severe acute respiratory syndrome coronavirus 2 isolate SARS-CoV-2/human/USA/N-MDOH-20210013232/2021, complete genome. [Severe acute respiratory syndrome coronavirus 2 (SARS-CoV-2)] Californian B.1.427 lineage | MW493681.1 (SEQ ID NO: 24) | | QQV21856.1 (SEQ ID NO: 25) | USA |
| Severe acute respiratory syndrome coronavirus 2 isolate SARS-CoV-2/human/USA/CA-CZB-12872/2020, complete genome. [Severe acute respiratory syndrome coronavirus 2 (SARS-CoV-2)] Californian B.1.429 lineage | MW306426.1 (SEQ ID NO: 26) | | QPJ72086.1 (SEQ ID NO: 27) | USA |

* Wu, F., et al. A new coronavirus associated with human respiratory disease in China (2020) Nature 579:265-269.
** All genome sequences are ss-RNA sequences wherein thymine (i.e. t or T) stands for uracil (as it is a RNA) in order to simplify the presentation (no difference made in the sequences between DNA and RNA). Info re ssRNA can be found in the header row of the Genebank entry.

FIG. 2T

| B.1.1.7 | B.1.351 | P.1 | Domain | Total 33 Weight | Cluster 13 A | 4 B | 10 C | 2 D | 1 E | 3 N | Ref aa |
|---|---|---|---|---|---|---|---|---|---|---|---|
|  | x | x | S-NTD | 0 | 0 | 0 | 0 | 0 | 0 | 0 | L18 |
|  | x |  | S-NTD | 0 | 0 | 0 | 0 | 0 | 0 | 0 | T20 |
|  |  | x | S-NTD | 0 | 0 | 0 | 0 | 0 | 0 | 0 | P26 |
| x |  |  | S-NTD | 0 | 0 | 0 | 0 | 0 | 0 | 0 | H69 |
| x |  |  | S-NTD | 0 | 0 | 0 | 0 | 0 | 0 | 0 | V70 |
|  | x |  | S-NTD | 0 | 0 | 0 | 0 | 0 | 0 | 0 | D80 |
|  |  |  | S-NTD | 1 | 0 | 0 | 0 | 0 | 0 | 1 | A123 |
|  |  | x | S-NTD | 0 | 0 | 0 | 0 | 0 | 0 | 0 | D138 |
|  |  |  | S-NTD | 1 | 0 | 0 | 0 | 0 | 0 | 1 | F140 |
|  |  |  | S-NTD | 1 | 0 | 0 | 0 | 0 | 0 | 1 | G142 |
| x |  |  | S-NTD | 3 | 0 | 0 | 0 | 0 | 0 | 3 | Y144 |
| x |  |  | S-NTD | 1 | 0 | 0 | 0 | 0 | 0 | 1 | Y145 |
|  |  |  | S-NTD | 1 | 0 | 0 | 0 | 0 | 0 | 1 | H146 |
|  |  |  | S-NTD | 1 | 0 | 0 | 0 | 0 | 0 | 1 | K147 |
|  |  |  | S-NTD | 1 | 0 | 0 | 0 | 0 | 0 | 1 | K150 |
|  |  |  | S-NTD | 1 | 0 | 0 | 0 | 0 | 0 | 1 | W152 |
|  |  |  | S-NTD | 1 | 0 | 0 | 0 | 0 | 0 | 1 | F157 |
|  |  |  | S-NTD | 1 | 0 | 0 | 0 | 0 | 0 | 1 | R158 |
|  |  |  | S-NTD | 1 | 0 | 0 | 0 | 0 | 0 | 1 | N164 |
|  |  | x | S-NTD | 0 | 0 | 0 | 0 | 0 | 0 | 0 | R190 |
|  | x | x | S-NTD | 0 | 0 | 0 | 0 | 0 | 0 | 0 | D215 |
|  | x |  | S-NTD | 0 | 0 | 0 | 0 | 0 | 0 | 0 | L242 |
|  | x |  | S-NTD | 0 | 0 | 0 | 0 | 0 | 0 | 0 | A243 |
|  | x |  | S-NTD | 0 | 0 | 0 | 0 | 0 | 0 | 0 | L244 |
|  |  |  | S-NTD | 1 | 0 | 0 | 0 | 0 | 0 | 1 | H245 |
|  | x |  | S-NTD | 1 | 0 | 0 | 0 | 0 | 0 | 1 | R246 |
|  |  |  | S-NTD | 1 | 0 | 0 | 0 | 0 | 0 | 1 | S247 |
|  |  |  | S-NTD | 1 | 0 | 0 | 0 | 0 | 0 | 1 | Y248 |
|  |  |  | S-NTD | 1 | 0 | 0 | 0 | 0 | 0 | 1 | L249 |
|  |  |  | S-RBD | 1 | 0 | 0 | 0 | 0 | 1 | 0 | N334 |
|  |  |  | S-RBD | 1 | 0 | 0 | 0 | 0 | 1 | 0 | L335 |
|  |  |  | S-RBD | 1 | 0 | 0 | 0 | 0 | 1 | 0 | P337 |

Listed are residues which are within the footprint of neutralizing mAbs and/or which are lineage defining mutation positions for B.1.1.7, B.1.351 or P.1 (marked 'x')

FIG. 13B

| B.1.1.7 | B.1.351 | P.1 | Domain | Total Weight | A (13) | B (4) | C (10) | D (2) | E (1) | N (3) | Ref aa |
|---|---|---|---|---|---|---|---|---|---|---|---|
| | | | | 33 | | | | | | | |
| | | | S-RBD | 1 | 0 | 0 | 0 | 0 | 1 | 0 | G339 |
| | | | S-RBD | 1 | 0 | 0 | 0 | 0 | 1 | 0 | E340 |
| | | | S-RBD | 1 | 0 | 0 | 0 | 0 | 1 | 0 | N343 |
| | | | S-RBD | 0 | 0 | 0 | 0 | 0 | 0 | 0 | A344 |
| | | | S-RBD | 3 | 0 | 0 | 1 | 1 | 1 | 0 | T345 |
| | | | S-RBD | 6 | 0 | 0 | 4 | 1 | 1 | 0 | R346 |
| | | | S-RBD | 1 | 0 | 0 | 1 | 0 | 0 | 0 | F347 |
| | | | S-RBD | 0 | 0 | 0 | 0 | 0 | 0 | 0 | A348 |
| | | | S-RBD | 1 | 0 | 0 | 1 | 0 | 0 | 0 | S349 |
| | | | S-RBD | 1 | 0 | 0 | 1 | 0 | 0 | 0 | Y351 |
| | | | S-RBD | 0 | 0 | 0 | 0 | 0 | 0 | 0 | A352 |
| | | | S-RBD | 1 | 0 | 0 | 0 | 0 | 1 | 0 | K356 |
| | | | S-RBD | 1 | 0 | 0 | 0 | 0 | 1 | 0 | R357 |
| | | | S-RBD | 1 | 0 | 0 | 0 | 0 | 1 | 0 | S359 |
| | | | S-RBD | 1 | 0 | 0 | 0 | 0 | 1 | 0 | N360 |
| | | | S-RBD | 1 | 0 | 0 | 0 | 0 | 1 | 0 | C361 |
| | | | S-RBD | 4 | 0 | 4 | 0 | 0 | 0 | 0 | Y369 |
| | | | S-RBD | 2 | 0 | 2 | 0 | 0 | 0 | 0 | N370 |
| | | | S-RBD | 1 | 0 | 1 | 0 | 0 | 0 | 0 | S371 |
| | | | S-RBD | 2 | 0 | 2 | 0 | 0 | 0 | 0 | A372 |
| | | | S-RBD | 1 | 0 | 1 | 0 | 0 | 0 | 0 | S373 |
| | | | S-RBD | 2 | 0 | 2 | 0 | 0 | 0 | 0 | F374 |
| | | | S-RBD | 3 | 0 | 3 | 0 | 0 | 0 | 0 | S375 |
| | | | S-RBD | 2 | 0 | 2 | 0 | 0 | 0 | 0 | T376 |
| | | | S-RBD | 4 | 0 | 4 | 0 | 0 | 0 | 0 | F377 |
| | | | S-RBD | 4 | 0 | 4 | 0 | 0 | 0 | 0 | K378 |
| | | | S-RBD | 4 | 0 | 4 | 0 | 0 | 0 | 0 | C379 |
| | | | S-RBD | 3 | 0 | 3 | 0 | 0 | 0 | 0 | Y380 |
| | | | S-RBD | 2 | 0 | 2 | 0 | 0 | 0 | 0 | G381 |
| | | | S-RBD | 2 | 0 | 2 | 0 | 0 | 0 | 0 | V382 |
| | | | S-RBD | 4 | 0 | 4 | 0 | 0 | 0 | 0 | S383 |

Listed are residues which are within the footprint of neutralizing mAbs and/or which are lineage defining mutation positions for B.1.1.7, B.1.351 or P.1 (marked 'x')

FIG. 13C

| B.1.1.7 | B.1.351 | P.1 | Domain | Total | Cluster | | | | | | Ref aa |
|---|---|---|---|---|---|---|---|---|---|---|---|
| | | | | 33 | 13 | 4 | 10 | 2 | 1 | 3 | |
| | | | | Weight | A | B | C | D | E | N | |
| | | | S-RBD | 4 | 0 | 4 | 0 | 0 | 0 | 0 | P384 |
| | | | S-RBD | 4 | 0 | 4 | 0 | 0 | 0 | 0 | T385 |
| | | | S-RBD | 2 | 0 | 2 | 0 | 0 | 0 | 0 | K386 |
| | | | S-RBD | 1 | 0 | 1 | 0 | 0 | 0 | 0 | N388 |
| | | | S-RBD | 1 | 0 | 1 | 0 | 0 | 0 | 0 | L390 |
| | | | S-RBD | 2 | 0 | 2 | 0 | 0 | 0 | 0 | F392 |
| | | | S-RBD | 10 | 10 | 0 | 0 | 0 | 0 | 0 | R403 |
| | | | S-RBD | 7 | 6 | 1 | 0 | 0 | 0 | 0 | D405 |
| | | | S-RBD | 1 | 1 | 0 | 0 | 0 | 0 | 0 | E406 |
| | | | S-RBD | 1 | 0 | 1 | 0 | 0 | 0 | 0 | V407 |
| | | | S-RBD | 5 | 3 | 2 | 0 | 0 | 0 | 0 | R408 |
| | | | S-RBD | 2 | 2 | 0 | 0 | 0 | 0 | 0 | Q409 |
| | | | S-RBD | 1 | 0 | 1 | 0 | 0 | 0 | 0 | A411 |
| | | | S-RBD | 3 | 0 | 3 | 0 | 0 | 0 | 0 | P412 |
| | | | S-RBD | 2 | 0 | 2 | 0 | 0 | 0 | 0 | G413 |
| | | | S-RBD | 3 | 0 | 3 | 0 | 0 | 0 | 0 | Q414 |
| | | | S-RBD | 11 | 11 | 0 | 0 | 0 | 0 | 0 | T415 |
| | | | S-RBD | 11 | 11 | 0 | 0 | 0 | 0 | 0 | G416 |
| x | x | | S-RBD | 11 | 10 | 0 | 1 | 0 | 0 | 0 | K417 |
| | | | S-RBD | 10 | 10 | 0 | 0 | 0 | 0 | 0 | D420 |
| | | | S-RBD | 11 | 11 | 0 | 0 | 0 | 0 | 0 | Y421 |
| | | | S-RBD | 2 | 0 | 2 | 0 | 0 | 0 | 0 | D427 |
| | | | S-RBD | 2 | 0 | 2 | 0 | 0 | 0 | 0 | D428 |
| | | | S-RBD | 2 | 0 | 2 | 0 | 0 | 0 | 0 | F429 |
| | | | S-RBD | 1 | 0 | 1 | 0 | 0 | 0 | 0 | T430 |
| | | | S-RBD | 1 | 0 | 1 | 0 | 0 | 0 | 0 | N437 |
| | | | S-RBD | 1 | 0 | 0 | 1 | 1 | 0 | 0 | S438 |
| | | | S-RBD | 1 | 0 | 0 | 1 | 1 | 0 | 0 | N439 |
| | | | S-RBD | 2 | 0 | 0 | 1 | 1 | 0 | 0 | N440 |
| | | | S-RBD | 4 | 0 | 0 | 1 | 1 | 1 | 0 | L441 |
| | | | S-RBD | 1 | 0 | 0 | 0 | 0 | 0 | 0 | D442 |

Listed are residues which are within the footprint of neutralizing mAbs and/or which are lineage defining mutation positions for B.1.1.7, B.1.351 or P.1 (marked 'x')

FIG. 13D

|  |  |  | | Total | Cluster | | | | | | |
|---|---|---|---|---|---|---|---|---|---|---|---|
|  |  |  | | 33 | 13 | 4 | 10 | 2 | 1 | 3 | |
| B.1.1.7 | B.1.351 | P.1 | Domain | Weight | A | B | C | D | E | N | Ref aa |
|  |  |  | S-RBD | 4 | 0 | 0 | 4 | 0 | 0 | 0 | K444 |
|  |  |  | S-RBD | 2 | 1 | 0 | 1 | 0 | 0 | 0 | V445 |
|  |  |  | S-RBD | 9 | 2 | 0 | 7 | 0 | 0 | 0 | G446 |
|  |  |  | S-RBD | 2 | 0 | 0 | 2 | 0 | 0 | 0 | G447 |
|  |  |  | S-RBD | 4 | 0 | 0 | 4 | 0 | 0 | 0 | N448 |
|  |  |  | S-RBD | 11 | 2 | 0 | 8 | 1 | 0 | 0 | Y449 |
|  |  |  | S-RBD | 4 | 0 | 0 | 4 | 0 | 0 | 0 | N450 |
|  |  |  | S-RBD | 1 | 0 | 0 | 1 | 0 | 0 | 0 | Y451 |
|  |  |  | S-RBD | 4 | 0 | 0 | 4 | 0 | 0 | 0 | L452 |
|  |  |  | S-RBD | 12 | 10 | 0 | 1 | 1 | 0 | 0 | Y453 |
|  |  |  | S-RBD | 15 | 12 | 0 | 2 | 1 | 0 | 0 | L455 |
|  |  |  | S-RBD | 15 | 12 | 0 | 2 | 1 | 0 | 0 | F456 |
|  |  |  | S-RBD | 11 | 11 | 0 | 0 | 0 | 0 | 0 | R457 |
|  |  |  | S-RBD | 11 | 11 | 0 | 0 | 0 | 0 | 0 | K458 |
|  |  |  | S-RBD | 4 | 4 | 0 | 0 | 0 | 0 | 0 | S459 |
|  |  |  | S-RBD | 11 | 11 | 0 | 0 | 0 | 0 | 0 | N460 |
|  |  |  | S-RBD | 0 | 0 | 0 | 0 | 0 | 0 | 0 | I468 |
|  |  |  | S-RBD | 1 | 0 | 0 | 1 | 0 | 0 | 0 | T470 |
|  |  |  | S-RBD | 0 | 0 | 0 | 0 | 0 | 0 | 0 | I472 |
|  |  |  | S-RBD | 12 | 11 | 0 | 1 | 0 | 0 | 0 | Y473 |
|  |  |  | S-RBD | 7 | 7 | 0 | 0 | 0 | 0 | 0 | Q474 |
|  |  |  | S-RBD | 14 | 12 | 0 | 2 | 0 | 0 | 0 | A475 |
|  |  |  | S-RBD | 13 | 12 | 0 | 1 | 0 | 0 | 0 | G476 |
|  |  |  | S-RBD | 12 | 11 | 0 | 1 | 0 | 0 | 0 | S477 |
|  |  |  | S-RBD | 2 | 2 | 0 | 0 | 0 | 0 | 0 | T478 |
|  |  |  | S-RBD | 2 | 0 | 0 | 2 | 0 | 0 | 0 | N481 |
|  |  |  | S-RBD | 2 | 0 | 0 | 2 | 0 | 0 | 0 | G482 |
|  |  |  | S-RBD | 4 | 0 | 0 | 4 | 0 | 0 | 0 | V483 |
|  | x | x | S-RBD | 9 | 0 | 0 | 8 | 1 | 0 | 0 | E484 |
|  |  |  | S-RBD | 9 | 1 | 0 | 7 | 1 | 0 | 0 | G485 |
|  |  |  | S-RBD | 18 | 12 | 0 | 5 | 1 | 0 | 0 | F486 |

Listed are residues which are within the footprint of neutralizing mAbs and/or which are lineage defining mutation positions for B.1.1.7, B.1.351 or P.1 (marked 'x')

FIG. 13E

| B.1.1.7 | B.1.351 | P.1 | Domain | Total | Cluster | | | | | | Ref aa |
|---|---|---|---|---|---|---|---|---|---|---|---|
| | | | | 33 | 13 | 4 | 10 | 2 | 1 | 3 | |
| | | | | Weight | A | B | C | D | E | N | |
| | | | S-RBD | 16 | 13 | 0 | 3 | 0 | 0 | 0 | N487 |
| | | | S-RBD | 2 | 0 | 0 | 2 | 0 | 0 | 0 | C488 |
| | | | S-RBD | 17 | 12 | 0 | 4 | 1 | 0 | 0 | Y489 |
| | | | S-RBD | 8 | 1 | 0 | 6 | 1 | 0 | 0 | F490 |
| | | | S-RBD | 3 | 0 | 0 | 2 | 1 | 0 | 0 | L492 |
| | | | S-RBD | 15 | 10 | 0 | 4 | 1 | 0 | 0 | Q493 |
| | | | S-RBD | 10 | 4 | 0 | 5 | 1 | 0 | 0 | S494 |
| | | | S-RBD | 9 | 9 | 0 | 0 | 0 | 0 | 0 | Y495 |
| | | | S-RBD | 7 | 6 | 0 | 1 | 0 | 0 | 0 | G496 |
| | | | S-RBD | 10 | 7 | 0 | 3 | 0 | 0 | 0 | Q498 |
| | | | S-RBD | 3 | 1 | 0 | 1 | 1 | 0 | 0 | P499 |
| | | | S-RBD | 9 | 8 | 0 | 1 | 0 | 0 | 0 | T500 |
| x | x | x | S-RBD | 13 | 12 | 0 | 1 | 0 | 0 | 0 | N501 |
| | | | S-RBD | 10 | 10 | 0 | 0 | 0 | 0 | 0 | G502 |
| | | | S-RBD | 3 | 2 | 1 | 0 | 0 | 0 | 0 | V503 |
| | | | S-RBD | 14 | 13 | 0 | 1 | 0 | 0 | 0 | Y505 |
| | | | S-RBD | 1 | 0 | 0 | 1 | 0 | 0 | 0 | R509 |
| | | | S-RBD | 0 | 0 | 0 | 0 | 0 | 0 | 0 | F515 |
| | | | S-RBD | 0 | 0 | 0 | 0 | 0 | 0 | 0 | E516 |
| | | | S-RBD | 2 | 0 | 0 | 2 | 0 | 0 | 0 | L517 |
| x | | | S-CDT1 | 0 | 0 | 0 | 0 | 0 | 0 | 0 | A570 |
| x | x | x | S-CDT2 | 0 | 0 | 0 | 0 | 0 | 0 | 0 | D614 |
| | | x | S-CDT2 | 0 | 0 | 0 | 0 | 0 | 0 | 0 | H655 |
| x | | | S-nearCLY | 0 | 0 | 0 | 0 | 0 | 0 | 0 | P681 |
| | x | | S-S2 | 0 | 0 | 0 | 0 | 0 | 0 | 0 | A701 |
| x | | | S-S2 | 0 | 0 | 0 | 0 | 0 | 0 | 0 | T716 |
| x | | | S-HR1 | 0 | 0 | 0 | 0 | 0 | 0 | 0 | S982 |
| | | x | S-CH | 0 | 0 | 0 | 0 | 0 | 0 | 0 | T1027 |
| x | | | S-CD | 0 | 0 | 0 | 0 | 0 | 0 | 0 | D1118 |
| | | x | S-HR2 | 0 | 0 | 0 | 0 | 0 | 0 | 0 | V1176 |

Listed are residues which are within the footprint of neutralizing mAbs and/or which are lineage defining mutation positions for B.1.1.7, B.1.351 or P.1 (marked 'x')

FIG. 13F

CPG-ADJUVANTED SARS-COV-2 VIRUS VACCINE

RELATED APPLICATIONS

This application is a continuation of International Patent Application Serial No. PCT/IB2021/052858, filed Apr. 6, 2021, which claims the benefit under 35 U.S.C. § 120 of International Patent Application Serial No. PCT/US2021/020313, filed Mar. 1, 2021, and which claims the benefit under 35 U.S.C. § 119(e) of U.S. Provisional Application Ser. No. 62/983,737, filed Mar. 1, 2020, the entire contents of each of which is incorporated by reference herein in its entirety

REFERENCE TO A SEQUENCE LISTING SUBMITTED AS A TEXT FILE VIA EFS-WEB

The instant application contains a Sequence Listing which has been submitted in ASCII format via EFS-Web and is hereby incorporated by reference in its entirety. Said ASCII copy, created on Sep. 8, 2021, is named IO422.70138US00-SEQ-JRV, and is 662,996 bytes in size.

FIELD OF THE INVENTION

The disclosure relates to CpG-adjuvanted SARS-CoV-2 vaccines and compositions and methods for producing said vaccines and administering the vaccines to subjects for the generation of an anti-SARSCoV-2 immune response.

BACKGROUND OF THE INVENTION

SARS-CoV-2 (hereinafter the "virus") was detected for the first time in China around November 2019. Since then, the virus has caused a global pandemic. The natural reservoir are bats and the virus belongs to the Coronaviridae family, genus Betacoronavirus (betaCoV). The virus has a ssRNA genome composed of 29,903 bp (Wuhan-Hu-1: Genbank Reference sequence: NC_045512.2), which encode a 9,860 amino acid polyprotein, comprising 25 non-structural proteins and 4 structural proteins: spike (S), envelope (E), membrane (M) and nucleocapsid (N) proteins. The virus particle has a variable diameter of between 60 and 140 nm. It is enveloped and sensitive to UV, heat, and lipid solvents. It has 89% nucleotide sequence identity with bat SARS-like-CoVZXC21 and 82% nucleotide sequence identity with human SARS-CoV (Chan et al. 2020). Evidence suggests that this virus spreads when an infected person coughs small droplets—packed with the virus—into the air. These can be breathed in, or cause an infection if one touches a surface they have landed on, then the eyes, nose or mouth. In addition, other vectors may exist, and the virus may be transmitted by blood transfusion, transplacentally, and through sexual transmission. Though infection with SARS-CoV-2 may result in only mild symptoms, such as, typically, a fever and a cough, or even be asymptomatic; in the other extreme, it can be fatal. The key symptoms are usually high temperature, cough and breathing difficulties. There is currently no specific treatment or vaccine for the virus, and the only preventative methods involve social distancing. SARS-CoV-2 presents a substantial public health threat. The Imperial College COVID-19 (disease caused by SARS-CoV-2) Response Team published in Mar. 16, 2020, a report evaluating all possible methods available to stop or delay the spread of the virus, which could ultimately lead to the break-down of the healthcare system and hundreds of thousands of deaths in the UK alone. The report stated that only population-wide social distancing has a chance to reduce effects to manageable levels and these measures need to be followed until a vaccine is available. This recommendation would mean for most of the population quarantine for at least 18 months. The report concluded that a mass-producible vaccine is the only option to stop this pandemic, other than a willingness to sacrifice the elderly population. In view of the dramatic situation, there is an absolute urgent need for an effective vaccine against SARS-CoV-2 as fast as possible. Furthermore, various escape mutants have emerged (e.g. UK_B.1.1.7; South African_B.1.351; Californian_B.1.427/B.1.429 and Brazilian_P.1 variants, see also FIG. 2) which further worsen the situation and thus addressing this unfortunate development needs to be addressed as well.

SUMMARY OF THE INVENTION

Accordingly, the present invention provides an inactivated whole virus SARS-CoV-2 vaccine. Multiple SARS-CoV-2 vaccines are in development, including vectored vaccines, whole-virion inactivated vaccines, and recombinant protein vaccines. Although mRNA or DNA vaccines or vectored vaccine candidates elicit T cell responses without adjuvants, adjuvants may be important for subunit and inactivated vaccines to increase their immunogenicity. Furthermore, a major challenge during rapid development is to avoid safety issues both by thoughtful vaccine design and by thorough evaluation in a timely manner With regard to a SARS-CoV-2 vaccine, safety concerns have been raised in relation to potential immune-mediated disease enhancement. There is evidence for disease enhancement in vaccinated animals after challenge with live virus in multiple studies with SARS-CoV-1 vaccine candidates, including an alum-adjuvanted whole virus inactivated vaccine candidate. In mice, immunopathology induced by SARS-CoV-1 was considered a consequence of a dominant Th2 type response to the vaccine antigens (Tseng C-T et al. 2012 Immunization with SARS Coronavirus Vaccines Leads to Pulmonary Immunopathology on Challenge with the SARS Virus. PloSone 7(4):e35421). This was not observed after including other adjuvants (e.g. CpG) in the vaccine or other vaccine formulations known to drive immune responses towards Th1. Insofar as an inactivated vaccine approach has been contemplated, the use of typical inactivating agents (e.g. formaldehyde) under standard conditions may have drawbacks, such as, particularly, destruction of native epitopes, which hinder development of an effective vaccine candidate. The present invention aims to address these problems and thus to produce a safe and effective whole-virus inactivated SARS-CoV-2 vaccine that overcomes the drawbacks of the prior art.

Thus in one aspect, the present invention provides a SARS-CoV-2 vaccine comprising an inactivated SARS-CoV-2 particle in combination with cytidine-phosphoguanosine (CpG) and alum adjuvantation. As mentioned above, the selection of an appropriate adjuvant or adjuvants for the SARS-CoV-2 vaccine may be of critical importance. Even though use of alum may not necessarily lead to Th2 skewing in humans, the addition of CpG is believed to mitigate possible vaccine-related disease enhancement safety concerns. The addition of CpG may further allow for significant reduction of the antigen dose needed to achieve seroconversion in a subject (i.e. "dose sparing"), another important consideration in light of the urgent global need for a SARS-CoV-2 vaccine. Lastly, addition of adjuvants can help generating robust immune responses in subjects particularly susceptible or vulnerable to SARS-CoV-2 morbidity or mortality, i.e. immunocompromised, pregnant or elderly subjects. Such vaccine compositions are described in more detail below.

In a preferred aspect, the surface of the inactivated SARS-CoV-2 particle in the vaccine presents a native conformation such that the vaccine is capable of generating neutralizing antibodies against native SARS-CoV-2 particles in a human subject. In particular, the present invention aims to provide optimally inactivated SARS-CoV-2 particles, which are incapable of replication and infection of human cells, but which retain immunogenic epitopes of viral surface proteins and are thus suitable for generating protective immunity in vaccinated subjects. By optimizing the inactivation process (e.g. using beta-propiolactone) and other steps in the production of the vaccine, including the selection of an appropriate adjuvant, a novel vaccine composition can be obtained that preserves a native surface conformation of SARS-CoV-2 particles and which reduces the risk of vaccine induced immunopathology or enhancement of disease. Thus in one aspect, the SARS-CoV-2 vaccine composition comprises a beta-propiolactone-inactivated SARS-CoV-2 particle, wherein the vaccine is capable of generating neutralizing antibodies against native SARS-CoV-2 particles in a human subject, preferably wherein a native surface conformation of the SARS-CoV-2 particle is preserved in the vaccine.

In a further particular aspect, the inventions aims to provide an optimal combination of optimally inactivated (e.g. beta-propiolactone-inactivated) SARS-CoV-2 particles, which are incapable of replication and infection of human cells, but which retain immunogenic epitopes of viral surface proteins and are thus suitable for generating protective immunity in vaccinated subjects. By an optimal combination of inactivated SARS-CoV-2 particles also in combination with alum and CpG adjuvantation, an improved vaccine composition can be obtained that is capable of generating neutralizing antibodies against native SARS-CoV-2 particles and/or other immunological responses in a human subject that are able to protect partly or fully more than 50%, preferably more than 60%, more than 70%, more than 80%, more than 90% of said vaccinated human subjects.

Each of the limitations of the invention can encompass various embodiments of the invention. It is therefore anticipated that each of the limitations of the invention involving any one element or combinations of elements can be included in each aspect of the invention. This invention is not limited in its application to the details of construction and the arrangement of components set forth in the following description or illustrated in the drawings. The invention is capable of other embodiments and of being practiced or of being carried out in various ways.

BRIEF DESCRIPTION OF THE DRAWINGS

The accompanying drawings are not intended to be drawn to scale. The figures are illustrative only and are not required for enablement of the disclosure. For purposes of clarity, not every component may be labeled in every drawing. In the drawings:

FIG. 2. During the course of the SARS-CoV-2 pandemic, SARS-CoV-2 genomic sequences from isolates from around the world have been reported including the recent new variants or lineages such as the UK B 1.1.7, Brazilian P1, Californian B.1.427/B.1.429 and South African B.1.351 lineages. The accession numbers and origins of complete SARS-CoV-2 genomic sequences are provided in tabular form, along with accession numbers for the corresponding orf1ab polyprotein and S protein, when available (– or no entry=not available).

DETAILED DESCRIPTION OF THE INVENTION

Figure 1:
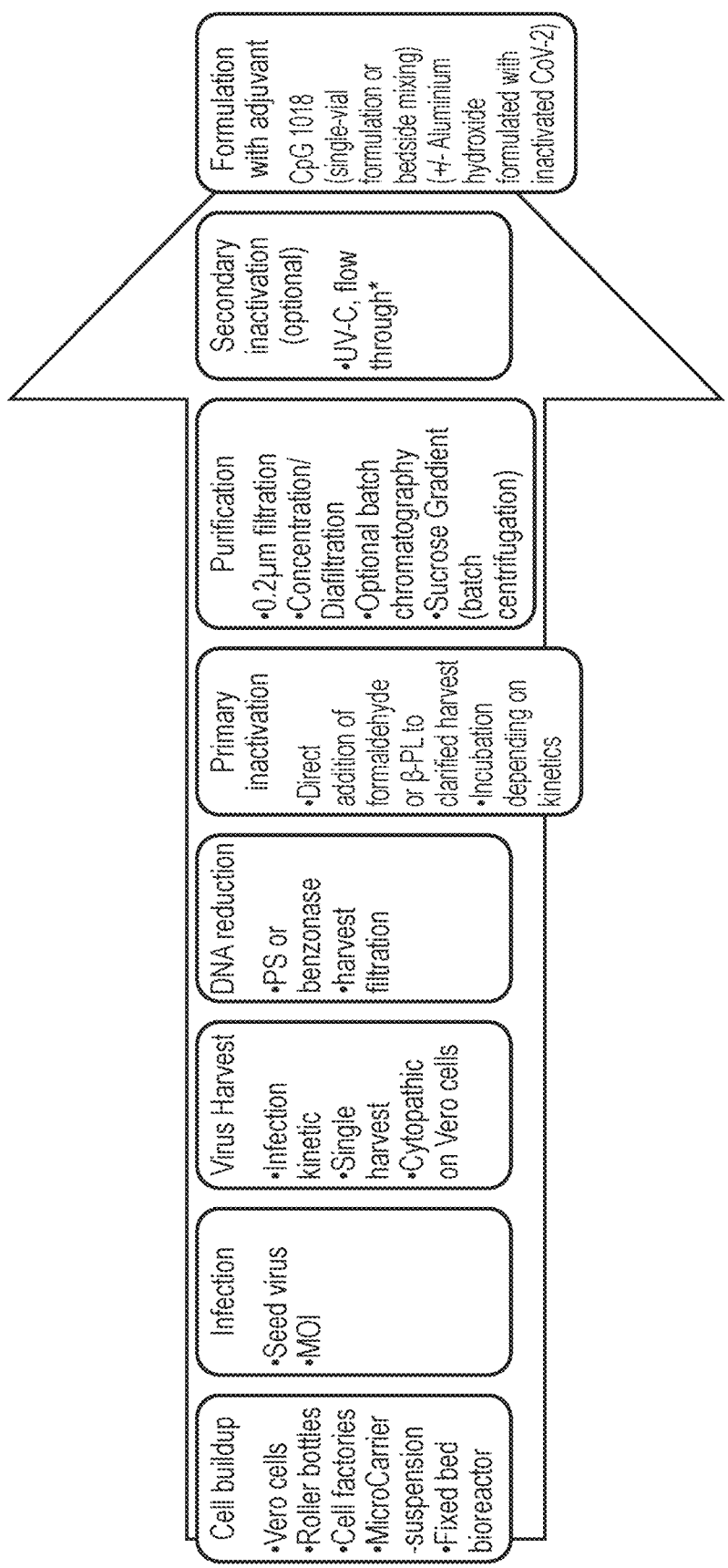
FIG. 1. The process for production of the inactivated SARS-CoV-2 vaccine of the current invention. Steps include cell buildup of Vero host cells, infection of Vero cells with SARS-CoV-2, virus harvest, DNA reduction, primary inactivation, purification, optional secondary inactivation and formulation with adjuvant. The virus may be formulated with or without aluminium hydroxide. The CpG adjuvant may be included in the same vial with the virus (and optional alum) or mixed with the virus before administration.

Embodiments of the present invention are directed to a SARS-CoV-2 vaccine or immunogenic composition comprising inactivated SARS-CoV-2 particles in combination with a CpG adjuvant. Typically, the inactivated SARS-CoV-2 particles are whole, inactivated particles, i.e. the inactivated virus particles are derived from whole native SARS-CoV-2 particles that have been inactivated. As used herein, "SARS-CoV-2" refers to the SARS-CoV-2 virus and "SARS-CoV-2 particles" typically refers to whole SARS-CoV-2 viral particles, i.e. virions.

In one embodiment, the inactivated SARS-CoV-2 particles are combined with the Th1 response-directing adjuvant CpG, preferably CpG 1018. As used herein, "CpG" refers to a cytosine-phospho-guanosine (CpG) motif-containing oligodeoxynucleotide (or CpG-ODN), e.g. which is capable of acting as a toll-like receptor 9 (TLR9) agonist. The CpG motif refers to an unmethylated cytidine-phospho-guanosine dinucleotide sequence, e.g. which is capable of binding to TLR9. Th1 response-directing adjuvants such as CpG promote the induction of a predominantly T helper type 1 (i.e. Th1) immune response in an immunized subject (rather than a Th2 type response), i.e. a "Th1-biased response". The Th1- or Th2-directing properties of commonly used vaccines are known in the art. It has surprisingly been found that using an adjuvant that promotes a Th1 response, e.g., CpG 1018, can improve immunogenicity of the vaccine and thus antiviral responses, as well as reducing the risk of disadvantageous effects such as immunopathology (which may result from a predominantly Th2 type response possibly due to hypersensitivity against viral components). In one embodiment, the SARS-CoV-2 vaccine of the current invention also comprises the Th2-stimulating adjuvant alum, which has a known tendency for Th2 skewing in humans. Neutralizing antibodies, the production of which is critical for anti-viral immunity, are strongly stimulated by Th2-stimulating adjuvants, such as e.g. alum. Also important for anti-viral immunity are cellular immune responses, which are only weakly stimulated by alum. Delivered together, alum and Th1-inducing adjuvants, such as CpG, can provide a potent anti-viral response. In short, the use of CpG and alum together in a vaccine formulation can provide a more balanced immune response to antigens, including both humoral and cellular components, and may have less deleterious effects than alum alone with a predominantly Th2 response.

In one embodiment, the CpG adjuvant comprised in the vaccine of the invention is a class A, class B or class C CpG (see Table A-1), preferably a class B CpG. Class B CpG molecules include CpG 1018, CpG 1826 and CpG 7909 (SEQ ID Nos: 4, 7 and 8, respectively; Table A-2). Most preferred is CpG 1018.

TABLE A-1

Comparative features of CpG classes A, B and C (Campbell J D, 2017, in Christopher B. Fox (ed.), Vaccine Adjuvants: Methods and Protocols, Methods in Molecular Biology, vol. 1494, DOI 10.1007/978-1-4939-6445-1_2).

| Class | Structural characteristics | Immunological characteristics |
|---|---|---|
| CpG-A | Phosphodiester CpG motif(s) Phosphorothioate poly-G at 5' and 3' Forms aggregates | Strong pDC IFN-α induction Moderate pDC maturation Weak B cell activation |

TABLE A-1-continued

Comparative features of CpG classes A, B and C (Campbell J D, 2017, in Christopher B. Fox (ed.), Vaccine Adjuvants: Methods and Protocols, Methods in Molecular Biology, vol. 1494, DOI 10.1007/978-1-4939-6445-1_2).

| Class | Structural characteristics | Immunological characteristics |
|---|---|---|
| CpG-B | Phosphorothioate backbone T-rich with CpG motifs Monomeric | Strong B cell activation Strong pDC maturation Weak pDC IFN-α induction |
| CpG-C | Phosphorothioate backbone 5'-TCG, CpG motif in central palindrome Forms duplexes | Good pDC IFN-α induction Good pDC maturation Good B cell activation |

IFN, interferon;
pDC, plasmacytoid dendritic cell

TABLE A-2

Class B CpGs

| | Sequence | SEQ ID NO: |
|---|---|---|
| CpG 1018 | TGACTGTGAACGTTCGAGATGA | 4 |
| CpG 1826 | TCCATGACGTTCCTGACGTT | 7 |
| CpG 7909 | TCGTCGTTTTGTCGTTTTGTCGTT | 8 |

CpG 1018 may be adsorbed onto alum and thus used as a combination adjuvant that induces both Th1 and Th2 responses (as described in e.g. Tian et al. Oncotarget, 2017, Vol. 8, (No. 28), pp: 45951-45964). Thus, in one embodiment, the CpG-adjuvanted vaccine composition of the invention further comprises aluminium ($Al^{3+}$), preferably in the form of an aluminium salt, e.g. aluminium oxide, aluminium hydroxide or aluminium phosphate, preferably aluminium hydroxide. A preferred aluminium salt is the aluminium hydroxide with reduced Cu content, e.g. lower than 1.25 ppb based on the weight of the vaccine composition, an adjuvant described in detail in WO2013/083726 or Schlegl et al., Vaccine 33 (2015) 5989-5996. In a preferred embodiment, the vaccine composition comprises both CpG and $Al^{3+}$, i.e., the adjuvant is a combination or mixture of CpG and $Al^{3+}$, preferably CpG 1018 (SEQ ID NO: 4) and $Al^{3+}$ provided in the form of aluminium hydroxide ($Al(OH)_3$). The presence of $Al^{3+}$ may reduce the required dose of CpG, i.e., have a "dose-sparing" effect. In one embodiment, the SARS-CoV-2 vaccine is formulated with $Al^{3+}$, and combined with a separate CpG-containing solution directly before vaccination of a subject; i.e. "bed-side mixing". In a preferred embodiment, the two adjuvants are both comprised in the formulation of the SARS-CoV-2 vaccine of the invention; i.e. "single-vial formulation".

In one embodiment, the $Al^{3+}$:CpG weight/weight (w/w) ratio, preferably the $Al^{3+}$ provided in the form of $Al(OH)_3$: CpG 1018 (w/w) ratio, in the vaccine composition is about 1:10, about 1:5, about 1:4, about 1:3, about 1:2, about 1:1, about 2:1, about 3:1, about 4:1, about 5:1, about 10:1, preferably between about 1:3 and 3:1, more preferably between about 1:2 and 1:1, most preferably about 1:2, even more preferably 1:2 in humans. In this regard, the effects of CpG in mice and humans are known to be very different, in part due to different TLR9 receptors which respond differently to CpG-DNA sequences as well as unique cellular distribution patterns of TLR9 expression in mice and humans (Chuang T S et al. 2002 Toll-like receptor 9 mediates CpG-DNA signaling. J Leukocyte Biol. (71)538-544). Therefore, the alum:CpG ratio giving an optimal response to any given antigen is likely to differ, perhaps substantially, in humans and mice. As referred to herein, the weight of the alum component refers to the weight of the $Al^{3+}$ in the solution, regardless of what type of aluminium salt is used. For example, 0.5 mg of $Al^{3+}$ corresponds to 1.5 mg alum. In one embodiment, the amount alum ($Al^{3+}$) present in the SARS-CoV-2 vaccine composition is between about 0.1 and 2 mg/mL, between about 0.2 and 1.5 mg/mL, between about 0.5 and 1.3 mg/mL, especially between about 0.8 to 1.2 mg/mL, most preferably about 1 mg/mL, i.e., 0.5 mg/dose. In a preferred embodiment, the relatively high amount of alum (compared with currently licensed alum-adjuvanted vaccines) is used to ensure complete binding of antigen, as well as binding of at least a portion of the total CpG in the formulation. In this regard, the ratio of alum:CpG affects the amount of "free" desorbed CpG, i.e., the CpG which is not bound to alum and/or antigen in the vaccine composition. In a preferred embodiment, the amount of free (unbound) CpG in the vaccine composition is greater than 10%, greater than 20%, greater than 30%, greater than 40%, greater than 50%, greater than 60%, greater than 70%, greater than 80%, greater than 90%, greater than 95%, preferably about 70% to 95%, most preferably about 80% to 90%, e.g. by weight (based on the total weight of CpG in the vaccine composition). In particular, the alum: CpG ratio should facilitate a majority of the CpG content in "free" (desorbed) CpG; i.e., the CpG is not bound to components of the vaccine such that it remains in a depot. In a preferred embodiment, the amount of free CpG versus bound CpG is greater than 50%, greater than 60%, greater than 70%, greater than 80%, greater than 85%, greater than 90%, preferably greater than between 70 to 90%, especially between about 80 and 90%, e.g. by weight (i.e. the amount of free CpG by weight based on the total weight of CpG in the vaccine composition). In one embodiment, the amount of CpG in the SARS-CoV-2 vaccine composition of the current invention is between about 0.25 and 6 mg/mL, between about 0.5 and 3 mg/mL, between about 1 and 3 mg/mL, especially between about 1.5 to 2.5 mg/mL, most preferably about 2 mg/mL, i.e., 1 mg/dose. In an especially preferred embodiment, the SARS-CoV-2 vaccine composition of the current invention is adjuvanted with 1 mg/mL $Al^{3+}$ and 2 mg/mL CpG 1018; i.e., 0.5 mg $Al^{3+}$ and 1 mg/mL CpG 1018 per dose.

In addition to the ratio of alum to CpG, different buffer systems may affect the adsorption of CpG to $Al^{3+}$ and/or antigen in the vaccine composition. For example, the use of a Tris buffer system in the vaccine composition resulted in reduced free CpG (i.e. reduced desorption), whereas a phosphate buffer system allowed better desorption of CpG. In a particular example, a phosphate-buffered formulation containing 1 mg/mL $Al^{3+}$ (aluminium hydroxide) and 2 mg/mL CpG 1018 (1:2 w/w ratio) had only about 10-20% bound CpG, i.e. about 80-90% free CpG. When formulated in phosphate buffer, about 0.3 mg of CpG is adsorbed per mg of $Al^{3+}$ (data not shown).

Typically, the adjuvant is combined with the inactivated SARS-CoV-2 particles during manufacture of the vaccine product, i.e. the manufactured vaccine product comprises the adjuvant and is sold/distributed in this form. In alternative embodiments the adjuvant may be combined with the inactivated SARS-CoV-2 particles at the point of use, e g immediately before clinical administration of the vaccine (sometimes referred to as "bedside mixing" of the components of the vaccine). Thus the present invention comprises both vaccine products comprising inactivated SARS-CoV-2 particles and an adjuvant as described herein, as well as kits comprising the individual components thereof (e.g. suitable for bedside mixing), and the combined use of the individual components of the vaccine in preventing or treating SARS-CoV-2 infection.

In some embodiments of the present invention, the SARS-CoV-2 particles are inactivated without substantially modifying their surface structure. In other words, a native surface conformation of the SARS-CoV-2 particles is retained in the inactivated virus particles. It has surprisingly been found that by optimizing an inactivation process, e.g. using beta-propiolactone, infectivity of native SARS-CoV-2 particles can be substantially abrogated, i.e., completely abolished, without adversely affecting their antigenicity and/or immunogenicity. Thus, the present invention provides in one aspect an inactivated virus vaccine (e.g. a beta-propiolactone-inactivated virus vaccine) that generates neutralizing antibodies and/or protective immunity against SARS-CoV-2 infection.

In one embodiment, the SARS-CoV-2 particles are inactivated by a method that preferentially targets viral RNA. By this it is meant that e.g. the inactivation step modifies viral RNA more than viral proteins. Thus, the inactivated SARS-CoV-2 particles may comprise replication-deficient viral RNA, i.e. the viral RNA is modified in the inactivation step such that the inactivated particles are incapable of replicating. By utilizing an inactivation method that preferentially targets viral RNA, the present invention advantageously allows the preservation of immunogenic epitopes in viral surface proteins.

Preferably, the inactivation method spares viral (surface) proteins relative to viral RNA, e.g. the viral surface proteins (e.g. the spike (S) protein) may comprise fewer or more infrequent modifications resulting from the inactivation step compared to viral RNA. For instance, a lower proportion of amino acid residues in the viral surface proteins (e.g. S protein) may be modified by the inactivation step compared to the proportion of modified nucleotide residues in the viral RNA. In some embodiments, the proportion of modified amino acid residues in the viral surface proteins (e.g. S protein) may be at least 5%, 10%, 20%, 30%, 50%, 70% or 90% lower than the proportion of modified nucleotide residues in the viral RNA. By "modifications" or "modified residues" it is meant to refer to non-native residues that are not present in the native SARS-CoV-2 particles, e.g. chemical (covalent) modifications of such residues resulting from the inactivation step.

In one embodiment, the viral RNA is inactivated by alkylation and/or acylation, i.e. the modifications in the SARS-CoV-2 inactivated particles comprise alkylated and/or acylated nucleotide residues. In some embodiments, the modifications are preferentially targeted to purine (especially guanine) residues, e.g. the SARS-CoV-2 inactivated particles comprise one or more modified (e.g. alkylated or acylated) guanine residues. In some cases, the inactivation step may lead to cross-linking of viral RNA with viral proteins, e.g. via guanine residues in the viral RNA. The inactivation step may also introduce nicks or strand breaks into viral RNA, e.g. resulting in fragmentation of the viral genome.

Suitable alkylating and/or acylating agents are known in the art. In one embodiment, the inactivating agent comprises beta-propiolactone, i.e. the vaccine comprises beta-propiolactone-inactivated virus particles. In any case, in a particular embodiment, beta-propiolactone (herein referred to also as "BPL") treatment is particularly preferred according to the present invention, because it results in SARS-CoV-2 particles, that are substantially inactive, but which retain high antigenicity and immunogenicity against neutralizing epitopes present in native SARS-CoV-2. In particular, it has been surprisingly found that beta-propiolactone can be used to inactivate SARS-CoV-2 particles with a minimum number of protein modifications. For instance, as demonstrated in Examples 7 and 10 below, inactivation of SARS-CoV-2 particles using beta-propiolactone results in a much lower number of modifications of viral proteins compared to inactivation of influenza particles by beta-propiolactone. Thus in beta-propiolactone-inactivated SARS-CoV-2 particles, a native surface conformation of the viral particles can be preserved.

In a preferred embodiment of the invention, the viral RNA is inactivated in an optimized manner, i.e. such it is just sufficiently inactivated not to be infectious anymore but not "over"-inactivated so that numerous modification at different amino acids in particular at the S-protein occur. In a further even more preferred embodiment, the BPL inactivation not only sufficiently inactivates (but not over-inactivates) the SARS-CoV-2 virus but also just sufficiently inactivates viruses that might be co-enriched and co-cultured in the manufacturing process (see e.g. experimental part). A particular hard virus to inactivate that can co-culture and be co-enriched is PPV (porcine parvovirus)—see experimental part. The concentration of beta-propiolactone in the inactivation step may be optimized to ensure complete inhibition of viral replication whilst preserving the conformation of surface proteins in the virus. For instance, the concentration of beta-propiolactone in the inactivation step may be e.g. 0.01 to 1% by weight, preferably 0.01 to 0.1% by weight, more preferably about 0.03% by weight. A preferred amount of BPL was found to be 500 ppm where the SARS-CoV-2 virus but also other concerning viruses/impurities are inactivated whilst preserving (i.e. not modifying) most of the amino acids of the S-protein (i.e. only a few amino acids were shown to be modified at low probability).

In some embodiments, the native SARS-CoV-2 particles may be contacted with beta-propiolactone for at least 5 hours, at least 10 hours, at least 24 hours or at least 4 days, e.g. 5 to 24 hours or longer such as 48 hours. The inactivation step may be performed at about 0° C. to about 25° C., preferably about 4° C. or about 22° C., or e.g. 18 to 24° C. In one embodiment the inactivation step (e.g. with beta-propiolactone) is performed at 2° C. to 8° C. for 24 hours. The inactivation step may optionally and preferably be followed by a hydrolyzation step of the inactivating agent, as is known in the art (which may be performed e.g. at about 37° C.+/−2° C. for a total time of 2.5 hours+/−0.5 hours for beta-propiolactone). Typically, longer incubation times and/or higher temperatures in the inactivation step may enhance viral inactivation, but may also lead to an increased risk of undesirable surface modifications of the viral particles, leading to reduced immunogenicity. Therefore, the inactivation step may be performed for e.g. the shortest time necessary in order to produce a fully inactivated virus particle. After completion of the hydrolysis, the inactivated viral solution was in one embodiment immediately cooled down to 5±3° C. and stored there until inactivation was confirmed by large volume plaque assay and serial passaging assay.

Beta-propiolactone inactivation of SARS-CoV-2 particles may preferentially modify cysteine, methionine and/or histidine residues. Thus in some embodiments, the inactivated SARS-CoV-2 particle comprises one or more beta-propiolactone-modified cysteine, methionine and/or histidine residues. However, in embodiments of the present invention, the beta-propiolactone-inactivated SARS-CoV-2 particles show relatively few protein modifications. Thus, for example, an inactivated SARS-CoV-2 particle in the vaccine may comprise fewer than 200, 100, 50, 30, 20, 15, 10, 9, 8, 7 or 6 beta-propiolactone-modified amino acid residues. Preferably a spike (S) protein of the inactivated SARS-CoV-2 particle comprises fewer than 100, 50, 30, 20, 15, 10, 9, 8, 7 or 6 beta-propiolactone-modified amino acid residues. More preferably the inactivated SARS-CoV-2 particle or spike protein thereof comprises 20 or fewer, 15 or fewer, 10 or fewer, or 5 or fewer beta-propiolactone-modified amino acid residues. Most preferably the inactivated SARS-CoV-2 particle or spike protein thereof comprises 1 to 100, 2 to 70, 3 to 50, 4 to 30, 5 to 25, 5 to 20, 10 to 20 or about 15 beta-propiolactone-modified amino acid residues.

In another embodiment, fewer than 20%, 15%, 10%, 5% or 4% of SARS-CoV-2 polypeptides are beta-propiolactone-modified. For instance, 0.1 to 10%, 1 to 8%, 2 to 7% or about 3%, 4%, 5% or 6% of SARS-CoV-2 polypeptides in the particle may be beta-propiolactone-modified. Beta-propiolactone modification of residues and/or polypeptides in the vaccine may be detected by mass spectrometry, e.g. using liquid chromatography with tandem mass spectrometry (LC-MS-MS), for instance using a method as described in Example 7 or Example 10. In such a method, the SARS-CoV-2 particles may be digested in order to fragment proteins into SARS-CoV-2 polypeptides for LC-MS-MS analysis. The digestion step may be performed by any suitable enzyme or combination of enzymes, e.g. by trypsin, chymotrypsin and/or PNGase F (peptide:N-glycosidase F), or by e.g. acid hydrolysis. Preferably the percentage of BPL-modified polypeptides detected by LC-MS-MS following enzymatic digestion or acid hydrolysis is: (a) trypsin digestion, 1 to 5%, 2 to 4% or about 3%; (b) trypsin+PNGase F digestion, 1 to 5%, 2 to 4% or about 3%; (c) chymotrypsin, 1 to 10%, 3 to 8% or about 6%; (d) acid hydrolysis, 1 to 6%, 2 to 5% or about 4%. In this context, a "beta-propiolactone-modified" polypeptide means that the polypeptide comprises at least one beta-propiolactone modification, e.g. at least one beta-propiolactone-modified residue.

In some embodiments, a spike (S) protein of the inactivated SARS-CoV-2 particle comprises a beta-propiolactone modification at one or more of the following residues: 49, 146, 166, 177, 207, 245, 379, 432, 519, 625, 1029, 1032, 1058, 1083, 1088, 1101, 1159 and/or 1271, e.g. in SEQ ID NO:3, or a corresponding position in SEQ ID NO: 19, 21, 23, 25 or 27. Preferably the inactivated SARS-CoV-2 particle comprises a beta-propiolactone modification at one or more of the following residues: H49, H146, C166, M177, H207, H245, C432, H519, H625, M1029, H1058, H1083, H1088, H1101, H1159 and/or H1271, e.g. in SEQ ID NO:3, or a corresponding position in SEQ ID NO: 19, 21, 23, 25 or 27. In another embodiment, the inactivated SARS-CoV-2 particle comprises a beta-propiolactone modification at one or more of the following residues: H207, H245, C379, M1029 and/or C1032, e.g. in SEQ ID NO:3, or a corresponding position in SEQ ID NO: 19, 21, 23, 25 or 27. By "a corresponding position" it is meant a position in SEQ ID NO: 19, 21, 23, 25 or 27 that aligns with position H207, H245, C379, M1029 and/or C1032 in SEQ ID NO:3, e.g. when SEQ ID NO: 19, 21, 23, 25 or 27 is aligned with SEQ ID NO:3 using a program such as NCBI Basic Local Alignment Search Tool (BLAST).

For instance, in some embodiments, the positions in SEQ ID NO: 19, 21, 23, 25 or 27 corresponding to H207, H245, C379, M1029 and C1032 in SEQ ID NO:3 are shown below:

| Seq ID | | | | | |
|---|---|---|---|---|---|
| 3 | H207 | H245 | C379 | M1029 | C1032 |
| 19 | H207 | H244 | C378 | M1028 | C1031 |
| 21 | H207 | H245 | C379 | M1029 | C1032 |
| 23 | H204 | H242 | C376 | M1026 | C1029 |
| 25 | H207 | H245 | C379 | M1029 | C1032 |
| 27 | H207 | H245 | C379 | M1029 | C1032 |

In some embodiments, a membrane (M) glycoprotein of the inactivated SARS-CoV-2 particle comprises a beta-propiolactone modification at one or more of the following residues: 125, 154, 155, 159 and/or 210, preferably H154, H155, C159 and/or H210, e.g. in SEQ ID NO: 29.

In some embodiments, a nucleocapsid (N) protein of the inactivated SARS-CoV-2 particle comprises a beta-propiolactone modification at M234, e.g. in SEQ ID NO: 28.

In some embodiments, fewer than 30%, 20%, 10%, 5%, 3% or 1% of one or more of the following residues in the inactivated SARS-CoV-2 particles are beta-propiolactone modified: (i) in the spike (S) protein, e.g. in SEQ ID NO:3, or a corresponding position in SEQ ID NO: 19, 21, 23, 25 or 27: residues 49, 146, 166, 177, 207, 245, 379, 432, 519, 625, 1029, 1032, 1058, 1083, 1088, 1101, 1159 and/or 1271; preferably H49, H146, C166, M177, H207, H245, C432, H519, H625, M1029, H1058, H1083, H1088, H1101, H1159 and/or H1271; alternatively H207, H245, C379, M1029 and/or C1032; (ii) in the membrane (M) glycoprotein, e.g. in SEQ ID NO: 29: residues 125, 154, 155, 159 and/or 210; preferably H154, H155, C159 and/or H210; and/or (iii) M234 of the nucleocapsid (N) protein, e.g. in SEQ ID NO: 28. In preferred embodiments, fewer than 30%, 20%, 10%, 5%, 3% or 1% of at least 2, 3, 4, 5, 6, 7, 8, 9, 10, 11, 12, 13, 14, 15, 16, 17, 18, 19, 20 or each of the above residues in the inactivated SARS-CoV-2 particles are beta-propiolactone modified. In this paragraph, the % of modified residues is intended to refer to the site occupancy, e.g. the ratio of modified to unmodified peptide for the same modification site normalized to the protein abundance as described in Example 7 or 10 below.

In another preferred embodiment, the proportion of beta-propiolactone-modified residues (i.e. site occupancy) at the following positions in the inactivated SARS-CoV-2 particles is:

(i) in the spike (S) protein (e.g. of SEQ ID NO: 3, or a corresponding position in SEQ ID NO: 19, 21, 23, 25 or 27):
  (a) H207: less than 30%, preferably 0.01 to 25%; and/or
  (b) H245: less than 10%, preferably 0.1 to 5%; and/or
  (c) C379: less than 5%, less than 1% or less than 0.1%; and/or
  (d) M1029: less than 5%, less than 1% or less than 0.1%; and/or
  (e) C1032: less than 5%, less than 1% or less than 0.1%; and/or
(ii) in the membrane (M) glycoprotein (e.g. of SEQ ID NO: 29):
  (f) H154: less than 5%, less than 1% or less than 0.1%; and/or
  (g) H155: less than 10%, preferably 0.1 to 5%; and/or
  (h) C159: less than 5%, less than 1% or less than 0.1%; and/or
  (i) H210: less than 20%, preferably 0.1 to 10%; and/or
(iii) in the nucleocapsid (N) protein (e.g. of SEQ ID NO: 28):
  (j) M234: less than 90%, less than 10% or less than 0.1%.

In another preferred embodiment, the proportion of beta-propiolactone-modified residues (i.e. site occupancy) at each of the following positions in the spike (S) protein (e.g. of SEQ ID NO: 3, or a corresponding position in SEQ ID NO: 19, 21, 23, 25 or 27) of the inactivated SARS-CoV-2 particles is:

(a) residues H49, H146, C166, H207, H519, M1029, H1083, H1088, H1101, H1159 and/or H1271: less than 20%, preferably 0.01 to 10%, more preferably 0.1 to 5%; and/or
(b) residues M177, C432, H625: less than 30%, preferably 0.1 to 20%, more preferably 1 to 10%; and/or
(c) residues H245, H1058: less than 30%, preferably 0.1 to 20%, more preferably 5 to 15%;

In some embodiments, the proportion of beta-propiolactone-modified amino acid residues in the inactivated SARS-CoV-2 particle (or spike (S) protein thereof) may be at least 5%, 10%, 20%, 30%, 50%, 70% or 90% lower than the proportion of modified residues in a beta-propiolactone-inactivated influenza particle (or hemagglutinin (HA) or neuraminidase (NA) protein thereof), e.g. in an influenza particle that has been inactivated under similar conditions to the SARS-CoV-2 particle.

In an alternative embodiment, the viral RNA may be inactivated by treatment with ultraviolet (UV) light. UV treatment can be used to preferentially target RNA (compared to polypeptides) in the viral particles, resulting in e.g. modified nucleotides and/or fragmentation. In some embodiments, UV treatment can be combined with beta-propiolactone treatment to improve inactivation of the virus, e.g. a beta-propiolactone treatment step can be followed by a UV treatment step or vice versa, or a UV treatment step can be performed at the same time as the beta-propiolactone treatment step.

In other embodiments, the native SARS-CoV-2 particles may be inactivated using formaldehyde. However, formaldehyde inactivation is typically less preferred in the present invention, as it is less suitable for preferentially targeting viral RNA while preserving immunogenic epitopes in the viral surface proteins.

Therefore, in preferred embodiments, the inactivation step(s) (especially when using formaldehyde, but also when using other inactivating agents such as e.g. beta-propiolactone) are performed under mild conditions in order to preserve surface antigen integrity, especially integrity of the S protein.

In one embodiment, such a mild inactivation method comprises contacting a liquid composition comprising native SARS-CoV-2 particles with a chemical viral inactivating agent (such as e.g. any of the chemical inactivation agents as listed above or a combination thereof, for instance formaldehyde or preferably beta-propiolactone) in a container, mixing the chemical viral inactivating agent and the liquid composition comprising SARS-CoV-2 particles under conditions of laminar flow but not turbulent flow, and incubating the chemical viral inactivating agent and the liquid composition comprising SARS-CoV-2 particles for a time sufficient to inactivate the viral particles. The mild inactivation step is optionally performed in a flexible bioreactor bag. The mild inactivation step preferably comprises five or less container inversions during the period of inactivation. Preferably, the mixing of the chemical viral inactivating agent and the composition comprising native SARS-CoV-2 particles comprises subjecting the container to rocking, rotation, orbital shaking, or oscillation for not more than 10 minutes at not more than 10 rpm during the period of incubation.

Suitable mild or gentle inactivation methods are described below in the Examples. Further details of such methods are also described in WO 2021/048221, the contents of which are incorporated herein in their entirety.

Typically, the inactivation step substantially eliminates infectivity of mammalian (e.g. human) cells by the inactivated SARS-CoV-2 particle. For instance, infectivity of mammalian cells may be reduced by at least 99%, 99.99% or 99.9999% as compared to a native SARS-CoV-2 particle, or infectivity of human cells by the inactivated A SARS-CoV-2 particle may be undetectable. Standard assays may be used for determining residual infectivity and effective viral titer, e.g. plaque assays, determination of $TCID_{50}$ (50% tissue culture infectious dose). For instance, the mammalian cells may be MDCK, COS or Vero cells.

In preferred embodiments of the present invention, a native surface conformation of the SARS-CoV-2 particles is preserved in the inactivated virus particles. By this it is meant that e.g. one or more, most or all immunogenic (neutralizing) epitopes are retained in the inactivated virus particles, such that the inactivated particles are capable of generating neutralizing antibodies against native SARS-CoV-2 particles when administered to a human subject. By "native surface conformation", it is meant to refer to the surface conformation found in native SARS-CoV-2 particles, i.e. SARS-CoV-2 particles (virions) that have not been inactivated. The property of the vaccine or inactivated SARS-CoV-2 particles in generating neutralizing antibodies in a subject may be determined using e.g. a plaque reduction neutralization test (PRNT assay), e.g. using a serum sample from the immunized subject as known in the art.

In preferred embodiments, the present invention comprises that a native conformation of (i) spike (S) protein; (ii) nucleocapsid (N) protein; (iii) membrane (M) glycoprotein; and/or (iv) envelope (E) protein is preserved in the inactivated viral particles. Preferably, the inactivated SARS-CoV-2 particle comprises a native conformation spike (S) protein. Thus, the S (and/or N and/or M and/or E) protein in the inactivated SARS-CoV-2 particle preferably comprises one or more or all (intact) immunogenic (neutralizing) epitopes present in native SARS-CoV-2 particles. Preferably, the S (and/or N and/or M and/or E) protein in the inactivated viral particles are not modified, or not substantially modified by the inactivation step.

Preservation of the surface conformation of the viral particles can be assessed using standard techniques. For instance, methods such as X-ray crystallography, MS analysis (shift of amino acid mass by modification) and cryo-electron microscopy may be used to visualize the virus surface. The secondary and tertiary structures of proteins present on the surface of viral particles may also be analyzed by methods such as by circular dichroism (CD) spectroscopy (e.g. in the far (190-250 nm) UV or near (250-300 nm) UV range). Moreover, preservation of a native surface conformation can be confirmed by using antibodies directed against epitopes present on the native viral surface, e.g. in the S protein. Reactivity of anti-SARS-CoV-2 antibodies with both the inactivated and native virus particles can thus be used to demonstrate retention of potentially neutralizing epitopes in the vaccine.

The surface conformation of SARS-CoV-2 virions and in particular the spike (S) protein is known, and has been published in several recent studies. See for instance Shang, J. et al. (Structural basis of receptor recognition by SARS-CoV-2. Nature doi.org/10.1038/s41586-020-2179-y (2020)), which describes the crystal structure of the SARS-CoV-2 receptor binding domain. In addition, Walls et al. (Structure, Function, and Antigenicity of the SARS-CoV-2 Spike Glycoprotein, Cell 180, 1-12 (2020), doi.org/10.1016/j.cell.2020.02.058) provides a detailed description of the S protein surface conformation using cryo-EM, and describes cross-neutralizing antibodies that target conserved S protein epitopes.

Monoclonal antibodies against SARS-CoV-2 surface epitopes (including in the S protein) are described in the literature (e.g. as mentioned above), available from commercial sources and/or can be generated using standard techniques, such as immunization of experimental animals. For example, as of Sep. 9, 2020, at least 169 different antibodies against SARS-CoV-2 were available from MyBioSource, Inc., San Diego, Calif. (e.g. cat. no. MBS8574747, see www.MyBioSource.com). On the same date at least 28 different antibodies against SARS-CoV-2 were available from Sino Biological US Inc., Wayne, Pa. (e.g. cat. no. 40150-D006, see www.sinobiological.com/). Further suitable antibodies are described in Ou et al. (Characterization of spike glycoprotein of SARS-CoV-2 on virus entry and its immune cross-reactivity with SARS-CoV, Nature Communications (2020) 11:1620; doi.org/10.1038/s41467-020-15562-9). In embodiments of the present invention, a skilled person can detect preservation of a native surface conformation of SARS-CoV-2 (or e.g. the S protein thereof) via binding of such antibodies to the inactivated particles. In other words, the inactivated particles bind specifically to one or more anti-SARS-CoV-2 antibodies directed against surface epitopes, preferably anti-S-protein antibodies, e.g. to antibodies generated against neutralizing epitopes in native SARS-CoV-2 virions.

The SARS-CoV-2 particles in the vaccine composition may be derived from any known strain of SARS-CoV-2, or variants thereof. For instance, the virus may be a strain as defined in FIG. 2, or may comprise a nucleotide or amino acid sequence as defined therein, or a variant sequence having at least e.g. 95% sequence identity thereto. For instance, in one embodiment the SARS-CoV-2 particle comprises an RNA sequence corresponding to a DNA sequence as defined by SEQ ID NOs: 1, 9, 12 or 15. In a preferred embodiment, the SARS-CoV-2 particle comprises an RNA sequence corresponding to the DNA sequence defined by SEQ ID NO: 9; i.e. the Italy-INMI1 SARS CoV-2 virus. This SARS-CoV-2 isolate was the first to be identified and characterized at the National Institute for Infectious Diseases "Lazzaro Spallanzani" IRCCS, Rome, Italy (Capobianchi M R, et al. Molecular characterization of SARS-CoV-2 from the first case of COVID-19 in Italy. 2020 Clin Microbiol Infect. 2020 July; 26(7): 954-956; doi: 10.1016/j.cmi.2020.03.025). By "corresponding to", it will be understood that the defined DNA sequence is an equivalent of the viral RNA sequence, i.e. is a DNA or cDNA sequence that encodes the viral RNA or a sequence complementary to the viral RNA. As described herein, the inactivation process may result in modification (e.g. alkylation or acylation) and/or fragmentation of viral RNA, and thus it will be understood that the inactivated viral particles may not comprise an intact RNA sequence as defined herein, but rather are derived from native viral particles which do comprise such a sequence.

The SARS-CoV-2 particles may also comprise variants of the known SARS-CoV-2 Wuhan-Hu-1 lineage or also referred to as the reference lineage, e.g. sequences having at least 85%, at least 90%, at least 95% or at least 99% sequence identity to SEQ ID NO: 1 and/or NCBI Reference Sequence NC_045512.2. Preferably, the variant sequence encodes an infectious SARS-CoV-2 particle, e.g. a native (non-inactivated) SARS-CoV-2 particle comprising the RNA sequence that is able to pack a virulent SARS-CoV-2 virus.

Further known SARS-CoV-2 particles may also comprise variants of the known SARS-CoV-2 South African lineage B.1.351, e.g. sequences having at least 85%, at least 90%, at least 95% or at least 99% sequence identity to SEQ ID NO: 18 and/or NCBI Reference Sequence MW598408. Preferably, the variant sequence encodes an infectious SARS-CoV-2 particle, e.g. a native (non-inactivated) SARS-CoV-2 particle comprising the RNA sequence that is able to pack a virulent SARS-CoV-2 virus. Further examples of variants of the known SARS-CoV-2 South African lineage B.1.351 are given in FIG. 2.

Further known SARS-CoV-2 particles may also comprise variants of the known SARS-CoV-2 Brazilian lineage P.1, e.g. sequences having at least 85%, at least 90%, at least 95% or at least 99% sequence identity to SEQ ID NO: 20 and/or NCBI Reference Sequence MW520923. Preferably, the variant sequence encodes an infectious SARS-CoV-2 particle, e.g. a native (non-inactivated) SARS-CoV-2 particle comprising the RNA sequence that is able to pack a virulent SARS-CoV-2 virus. Further examples of variants of the known SARS-CoV-2 Brazilian lineage P.1 are given in FIG. 2.

Further known SARS-CoV-2 particles may also comprise variants of the known SARS-CoV-2 UK lineage B.1.1.7, e.g. sequences having at least 85%, at least 90%, at least 95% or at least 99% sequence identity to SEQ ID NO: 22 and/or NCBI Reference Sequence MW422256. Preferably, the variant sequence encodes an infectious SARS-CoV-2 particle, e.g. a native (non-inactivated) SARS-CoV-2 particle comprising the RNA sequence that is able to pack a virulent SARS-CoV-2 virus. Further examples of variants of the known SARS-CoV-2 UK lineage B.1.1.7 are given in FIG. 2.

Further known SARS-CoV-2 particles may also comprise variants of the known SARS-CoV-2 Californian lineages B.1.427 and B.1.429, e.g. sequences having at least 85%, at least 90%, at least 95% or at least 99% sequence identity to SEQ ID NO: 24 and/or SEQ ID NO: 26. Preferably, the variant sequence encodes an infectious SARS-CoV-2 particle, e.g. a native (non-inactivated) SARS-CoV-2 particle comprising the RNA sequence that is able to pack a virulent SARS-CoV-2 virus. Further examples of variants of the known SARS-CoV-2 Californian lineages can be found in Genebank.

Similarly, in preferred embodiments the SARS-CoV-2 particle comprises an S protein of the Wuhan lineage comprising or consisting of (i) an amino acid sequence as defined in SEQ ID NO: 3, or (ii) an amino acid sequence having at least 95%, at least 97% or at least 99% identity to SEQ ID NO: 3.

In further preferred embodiments the SARS-CoV-2 particle comprises an S protein of the South African B1.351 lineage comprising or consisting of (i) an amino acid sequence as defined in SEQ ID NO: 19, or (ii) an amino acid sequence having at least 95%, at least 97% or at least 99% identity to SEQ ID NO: 19.

In further preferred embodiments the SARS-CoV-2 particle comprises an S protein of the Brazilian P.1 lineage comprising or consisting of (i) an amino acid sequence as defined in SEQ ID NO: 21, or (ii) an amino acid sequence having at least 95%, at least 97% or at least 99% identity to SEQ ID NO: 21.

In further preferred embodiments the SARS-CoV-2 particle comprises an S protein of the UK B.1.1.7 lineage comprising or consisting of (i) an amino acid sequence as defined in SEQ ID NO: 23, or (ii) an amino acid sequence having at least 95%, at least 97% or at least 99% identity to SEQ ID NO: 23.

In further preferred embodiments the SARS-CoV-2 particle comprises an S protein of the Californian B.1.427 lineage comprising or consisting of (i) an amino acid sequence as defined in SEQ ID NO: 25, or (ii) a an amino acid sequence having at least 95%, at least 97% or at least 99% identity to SEQ ID NO: 25.

In further preferred embodiments the SARS-CoV-2 particle comprises an S protein of the Californian B.1.429 lineage comprising or consisting of (i) an amino acid sequence as defined in SEQ ID NO: 27, or (ii) an amino acid sequence having at least 95%, at least 97% or at least 99% identity to SEQ ID NO: 27.

In some embodiments, the inactivated SARS-CoV-2 particles are combined with other inactivated SARS-CoV-2 particles in the vaccine (other=other sequence).

In some embodiments, a combination of SARS-CoV-2 particles in the vaccine comprises or consists of at least two SARS-CoV-2 particles selected from the group consisting of i) the reference Wuhan_1 lineage such as e.g. SEQ ID NOs 1, 9, 12, 15; ii) the South African B.1.531 lineage such as e.g. SEQ ID NO: 18; the Brazilian P.1 lineage such as e.g. SEQ ID NO: 20; the UK B.1.1.7 lineage such as e.g. SEQ ID NO: 22 and the Californian B.1.427 such as e.g. SEQ ID NO: 24 or B.1.429 lineages such as e.g. SEQ ID NO: 26. A preferred embodiment is a combination comprising i) a Wuhan_1 lineage such as e.g. SEQ ID NO: 9; and ii) a South African B.1.531 lineage such as e.g. SEQ ID NO: 18.

In a further embodiment, a combination of SARS-CoV-2 particles in the vaccine comprises or consists of at least three, e.g. three SARS-CoV-2 particles selected from the group consisting of i) the reference Wuhan_1 lineage such as e.g. SEQ ID NOs 1, 9, 12, 15; ii) the South African B.1.531 lineage such as e.g. SEQ ID NO: 18; the Brazilian P.1 lineage such as e.g. SEQ ID NO: 20; the UK B.1.1.7 lineage such as e.g. SEQ ID NO: 22 and the Californian B.1.427 such as e.g. SEQ ID NO: 24 or B.1.429 lineages such as e.g. SEQ ID NO: 26. A preferred embodiment of such a trivalent vaccine is a combination comprising i) a Wuhan_1 lineage such as e.g. SEQ ID NO: 9; and ii) a South African B.1.531 lineage such as e.g. SEQ ID NO: 18; and iii) an UK B.1.1.7 lineage such as e.g. SEQ ID NO: 22. Another preferred embodiment of such a trivalent vaccine is a combination comprising i) a Wuhan_1 lineage such as e.g. SEQ ID NO: 9; and ii) a South African B.1.531 lineage such as e.g. SEQ ID NO: 18; and iii) a Brazilian P.1 lineage such as e.g. SEQ ID NO: 20.

The similarity between amino acid sequences and/or nucleic acid sequences is expressed in terms of the percentage of identical matches between the sequences, otherwise referred to as sequence identity. Sequence identity is frequently measured in terms of percentage identity; the higher the percentage, the more similar the two sequences are. Homologs, orthologs, or variants of a polynucleotide or polypeptide will possess a relatively high degree of sequence identity when aligned using standard methods.

Methods of alignment of sequences for comparison are well known in the art. Various programs and alignment algorithms are described in: Smith & Waterman, Adv. Appl. Math. 2:482, 1981; Needleman & Wunsch, Mol. Biol. 48:443, 1970; Pearson & Lipman, Proc. Natl. Acad. Sci. USA 85:2444, 1988; Higgins & Sharp, Gene, 73:237-44, 1988; Higgins & Sharp, CABIOS 5: 151-3, 1989; Corpet et al., Nuc. Acids Res. 16: 10881-90, 1988; Huang et al.

Computer Appls. in the Biosciences 8, 155-65, 1992; and Pearson et al., Meth. Mol. Bio. 24:307-31, 1994. Altschul et al, J. Mol. Biol. 215:403-10, 1990, presents a detailed consideration of sequence alignment methods and homology calculations.

Once aligned, the number of matches is determined by counting the number of positions where an identical nucleotide or amino acid residue is present in both sequences. The percent sequence identity is determined by dividing the number of matches either by the length of the sequence set forth in the identified sequence, or by an articulated length (such as 100 consecutive nucleotides or amino acid residues from a sequence set forth in an identified sequence), followed by multiplying the resulting value by 100. Preferably, the percentage sequence identity is determined over the full length of the sequence. For example, a peptide sequence that has 1166 matches when aligned with a test sequence having 1554 amino acids is 75.0 percent identical to the test sequence (1166÷1554*100=75.0). The percent sequence identity value is rounded to the nearest tenth. For example, 75.11, 75.12, 75.13, and 75.14 are rounded down to 75.1, while 75.15, 75.16, 75.17, 75.18, and 75.19 are rounded up to 75.2. The length value will always be an integer.

The NCBI Basic Local Alignment Search Tool (BLAST) (Altschul et al., Mol. Biol. 215:403, 1990) is available from several sources, including the National Center for Biotechnology Information (NCBI, Bethesda, Md.) and on the internet, for use in connection with the sequence analysis programs BLASTP, BLASTN, BLASTX, TBLASTN and TBLASTX. A description of how to determine sequence identity using this program is available on the NCBI website on the internet. The BLAST and the BLAST 2.0 algorithms are also described in Altschul et al., Nucleic Acids Res. 25:3389-3402, 1977. Software for performing BLAST analyses is publicly available through the National Center for Biotechnology Information (ncbi.nlm.nih.gov). The BLASTN program (for nucleotide sequences) uses as defaults a word length (W) of 11, alignments (B) of 50, expectation (E) of 10, M=5, N=−4, and a comparison of both strands. The BLASTP program (for amino acid sequences) uses as defaults a word length (W) of 3, and expectation (E) of 10, and the BLOSUM62 scoring matrix (see Henikoff & Henikoff, Proc. Natl. Acad. Sci. USA 89: 10915, 1989).

Homologs and variants of a polynucleotide or polypeptide are typically characterized by possession of at least about 75%, for example at least about 80%, 85%, 90%, 91%, 92%, 93%, 94%, 95%, 96%, 97%, 98% or 99% sequence identity counted over at least 50, 100, 150, 250, 500, 1000, 2000, 5000 or 10,000 nucleotide or amino acid residues of the reference sequence, over the full length of the reference sequence or over the full length alignment with the reference amino acid sequence of interest. Polynucleotides or proteins with even greater similarity to the reference sequences will show increasing percentage identities when assessed by this method, such as at least 80%, at least 85%, at least 90%, at least 95%, at least 98%, or at least 99% sequence identity. For sequence comparison of amino acid or nucleic acid sequences, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters are used.

One example of a useful algorithm is PILEUP, which uses a simplification of the progressive alignment method of Feng & Doolittle, Mol. Evol. 35:351-360, 1987. The method used is similar to the method described by Higgins & Sharp, CABIOS 5:151-153, 1989. Using PILEUP, a reference sequence is compared to other test sequences to determine the percent sequence identity relationship using the following parameters: default gap weight (3.00), default gap length weight (0.10), and weighted end gaps. PILEUP can be obtained from the GCG sequence analysis software package, e.g., version 7.0 (Devereaux et al., Nuc. Acids Res. 12:387-395, 1984).

As used herein, reference to "at least 80% identity" refers to at least 80%, at least 85%, at least 90%, at least 91%, at least 92%, at least 93%, at least 94%, at least 95%, at least 96%, at least 97%, at least 98%, at least 99%, or even 100% identity to a specified reference sequence, e.g. to at least 50, 100, 150, 250, 500, 1000, 5000 or 10,000 nucleotide or amino acid residues of the reference sequence or to the full length of the sequence. As used herein, reference to "at least 90% identity" refers to at least 90%, at least 91%, at least 92%, at least 93%, at least 94%, at least 95%, at least 96%, at least 97%, at least 98%, at least 99%, or even 100% identity to a specified reference sequence, e.g. to at least 50, 100, 150, 250, 500, 1000, 5000 or 10,000 nucleotide or amino acid residues of the reference sequence or to the full length of the sequence.

The SARS-CoV-2 vaccine may be produced by methods involving a step of inactivation of native SARS-CoV-2 particles, as described above. Generally, the native SARS-CoV-2 particles may be obtained by standard culture methods, e.g. by in vitro production in mammalian cells, preferably using Vero cells. For instance, the native SARS-CoV-2 particles may be produced using methods analogous to those described in e.g. WO 2017/109225 and/or WO 2019/057793 (the contents of which are incorporated herein in their entirety), which describe methods for the production of Zika and Chikungunya viruses in Vero cells. The steps such as passaging, harvesting, precipitation, dialysis, filtering and purification described in those documents are equally applicable to the present process for producing SARS-CoV-2 particles.

For instance, in some embodiments, the method may comprise purifying the inactivated SARS-CoV-2 particles by one or more size exclusion methods such as (i) a sucrose density gradient centrifugation, (ii) a solid-phase matrix packed in a column comprising a ligand-activated core and an inactive shell comprising pores, wherein the molecular weight cut-off of the pores excludes the virus particles from entering the ligand-activated core, and wherein a molecule smaller than the molecular weight cut-off of the pores can enter the ligand-activated core and collecting the virus particles, and/or (iii) batch or size exclusion chromatography; to obtain purified inactivated SARS-CoV-2 particles. Preferably, in the resulting purified preparation of viral particles, (i) the concentration of residual host cell DNA is less than 100 ng/mL; (ii) the concentration of residual host cell protein is less than 1 µg/mL; and (iii) the concentration of residual aggregates of infectious virus particles is less than 1 µg/mL.

In some embodiments, the method may comprise a step of precipitating a harvested culture medium comprising SARS-CoV-2 particles, thereby producing native SARS-CoV-2 particles in a supernatant. The precipitating step may comprise contacting the culture medium with protamine sulfate or benzonase. By using such a step, both contaminating DNA derived from host cells as well as immature and otherwise non-infectious virus particles can be separated from the preparation. Moreover, protamine sulfate can be very efficiently separated from the virus fraction, e.g. using sucrose density centrifugation or a solid-phase matrix packed in a column comprising a ligand-activated core and an inactive shell comprising pores, wherein the pores comprise a molecular weight cut-off that excludes the virus particles from entering the ligand-activated core, and wherein a molecule smaller than the molecular weight cut-off of the pores (e.g. the protamine sulfate) can enter the ligand-activated core, allowing for a safer vaccine produced at high yields.

Thus the residual host cell DNA of the obtained virus preparation or vaccine may be less than 1 µg/mL, especially less than 900, 800, 700, 600, 500, 400, 300 or 200 ng/mL, preferably less than 150 or 100 ng/mL. In a preferred embodiment, the residual host cell DNA of the virus preparation or vaccine is less than 40 pg/mL. In some embodiments, the residual host cell protein of the virus preparation or vaccine is less than 10 µg/mL, especially less than 9, 8, 7, 6, 5, 4, 3 or 2 µg/mL, preferably less than 1 µg/mL. In a preferred embodiment, the residual host cell protein of the virus preparation or vaccine is less than 150 ng/mL. In some embodiments, the residual non-infectious virus particles of the virus preparation or vaccine is less than 10 µg/mL, especially less than 9, 8, 7, 6, 5, 4, 3 or 2 µg/mL, preferably less than 1 µg/mL. In a preferred embodiment, the content of residual non-infectious virus particles of the virus preparation or vaccine is less than 100 ng/mL.

In some embodiments, the vaccine and/or SARS-CoV-2 particles may comprise residual protamine (e.g. protamine sulfate), typically in trace amounts. In some embodiments, residual protamine (e.g. protamine sulfate) in the virus preparation or vaccine is less than 2 µg/mL or 1 µg/mL, especially less than 900, 800, 700, 600, 500, 400, 300 or 200 ng/mL, preferably less than 100 ng/mL, more preferably is below the detection limit of HPLC, in particular below the detection limit in the final drug substance.

In some embodiments, the PS content is tested by HPLC or size exclusion chromatography (SEC). For example, HPLC is validated for PS determination in JEV sucrose gradient pool samples as a routine release assay and is very sensitive (i.e., limit of quantification (LOQ) 3 µg/mL; limit of detection (LOD) 1 µg/mL). In the current invention, PS content in SARS-CoV-2 drug substance was <LOD. In one embodiment, the HPLC assessment of PS content can be performed on a Superdex Peptide 10/300GL column (GE: 17-5176-01) using 30% Acetonitrile, 0.1% Trifluoroacetic acid as solvent with a flow rate of 0.6 ml/min at 25° C. and detection at 214 nm. A more sensitive method of measurement for residual protamine in a purified virus preparation is mass spectrometry (MS). In some embodiments, the residual PS levels in a Zika virus preparation are tested by MS or other such highly sensitive method, e.g. nuclear magnetic resonance (NMR). With this method, residual PS, as well as fragments and/or break-down products of PS, can be detected at trace amounts, such as levels as low as, for example, $10^6$, $10^7$ or $10^8$ molecules per typical sample load. In some embodiments, the PS levels are tested in the drug product. In some embodiments, the PS levels are tested in the drug substance.

Preferably an amount of the inactivating agent (e.g. beta-propiolactone) in the drug product or drug substance (e.g. vaccine composition) is very low, e.g. less than 100 ppm, less than 10 ppm, or less than 1 ppm (by weight).

The SARS-CoV-2 vaccine may be administered to a subject, preferably a mammalian subject, more preferably a human subject. Typically, the SARS-CoV-2 vaccine is administered to a subject at risk of SARS-CoV-2 infection, e.g. in order to prevent SARS-CoV-2 infection and/or to prevent SARS-CoV-2 associated disease (COVID-19). The subject is preferably (i) an elderly subject (e.g. older than 65 years, 70 years or 80 years) (ii) a pregnant subject (iii) an immunocompromised subject or (iv) a child (e.g. a person younger than 18 years, 16 years, 14 years, 12 years, 10 years, 8 years, 6 years, 4 years, 2 years or younger). The SARS-CoV-2 vaccine described herein is advantageously capable of generating robust immune responses in subjects particularly susceptible or vulnerable to SARS-CoV-2 morbidity or mortality, i.e. immunocompromised, pregnant or elderly subjects. The SARS-CoV-2 vaccine may be administered to the subject in a single dose or two or more doses, e.g. separated by intervals of about 7, 14, 21 or 28 days.

In a preferred embodiment, on administration to a human subject the vaccine does not induce vaccine mediated disease enhancement (potentially through Antibody dependent enhancement). Vaccine-mediated disease enhancement is characterized by a vaccine that results in increased disease severity if the subject is later infected by the natural virus. It is an advantage of the present invention that the inactivated SARS-CoV-2 vaccine described herein does not promote vaccine mediated disease enhancement in human subjects, and can therefore be safely used for mass vaccination purposes. In particular, the vaccine described herein retains high quality immunogenic epitopes, which therefore results in high neutralizing antibody titers and diminishes the risk of vaccine mediated disease enhancement on administration to subjects. The risk of vaccine mediated disease enhancement development may be assessed in non-human primates. Guidance in this regard is given in the Consensus summary report for CEPI/BC Mar. 12-13, 2020 meeting: Assessment of risk of disease enhancement with COVID-19 vaccines (Lambert, P-H, et al. 2020, doi: 10.1016/j.vaccine.2020.05.064).

In another preferred embodiment, on administration to a human subject the vaccine does not result in immunopathology. In mice, SARS-CoV-1 vaccine induced immunopathology was considered a consequence of a dominant Th2 type response to the vaccine antigens (Tseng et al., 2012, supra). In embodiments of the present invention, a Th1 type response is enhanced or favored, e.g. by use of the Th1-directing adjuvant CpG. The risk of immunopathology developing may be assessed in animal models, e.g. as described in Tseng C. T. et al. (2012) PLoS ONE 7(4): e35421.

Any of the SARS-CoV-2 vaccines or compositions described herein may be administered to a subject in a therapeutically effective amount or a dose of a therapeutically effective amount. As used herein, a "therapeutically effective amount" of vaccine is any amount that results in a desired response or outcome in a subject, such as those described herein, including but not limited to prevention of infection, an immune response or an enhanced immune response to SARS-CoV-2, or prevention or reduction of symptoms associated with SARS-CoV-2 disease.

In some embodiments, the therapeutically effective amount or prophylactically effective amount (dosage) of a SARS-CoV-2 vaccine or composition described herein is an amount sufficient to generate antigen-specific antibodies (e.g., anti-SARS-CoV-2 antibodies). In some embodiments, the therapeutically or prophylactically effective amount is sufficient to seroconvert a subject with at least 70% probability. In some embodiments, the therapeutically or prophylactically effective amount is sufficient to seroconvert a subject with at least 75%, 80%, 85% 90%, 95%, 96%, 97%, 98%, or at least 99% probability. Whether a subject has seroconverted can be assessed by any method known in the art, such as obtaining a serum sample from the subject and performing an assay to detect anti-SARS-CoV-2 antibodies. In some embodiments, a subject is seroconverted if a serum sample from the subject contains an amount of anti-SARS-CoV-2 antibodies that surpasses a threshold or predetermined baseline. A subject is generally considered seroconverted if there is at least a 4-fold increase in anti-SARS-CoV-2 antibodies (i.e., anti-SARS-CoV-2 S protein IgG antibodies) present in a serum sample from the subject as compared to a serum sample previously taken from the same subject.

In one embodiment, the dose of the inactivated SARS-CoV-2 virus in the vaccine composition of the current invention is between about 0.01 and 25 mAU (milli-absorption units×minutes as assessed by SEC-HPLC), preferably between about 0.05 and 10 mAU, more preferably between about 0.1 and 5 mAU, most preferably between about 0.25 and 2.5 mAU. In one embodiment, the dose is between about 0.05 and 50 µg total protein as measured by (µ) BCA assay, between about 0.1 and 25 µg, between about 0.25 and 12.5 µg, preferably between about 0.5 and 5 µg total protein. More preferably the dose of the inactivated SARS-CoV-2 virus in the vaccine composition is at least 2.5 µg total protein, at least 3.5 µg total protein or at least 2.5 µg total protein, e.g. the vaccine composition comprises 2.5 µg to 25 µg, 3.5 µg to 10 µg or 4 µg to 6 µg total protein/dose, preferably about 5 µg total protein/dose. In some embodiments, the dosage is determined by the total amount of S protein in the inactivated SARS-CoV-2 formulation, as assessed by e.g. ELISA. The mass of antigen may also be estimated by assessing the SE-HPLC peak area per dose equivalent (recorded as milli-absorption units×minutes; mAU), which is estimated to be approximately 2 µg/ml total surface protein and approximately 1 µg/mL S-protein. In one embodiment, the dose is between about 0.025 and 25 µg S-protein as measured by ELISA, between about 0.05 and 12.5 µg, between about 0.125 and 6.25 µg, preferably between about 0.25 and 2.5 µg S-protein.

Figure 13A:
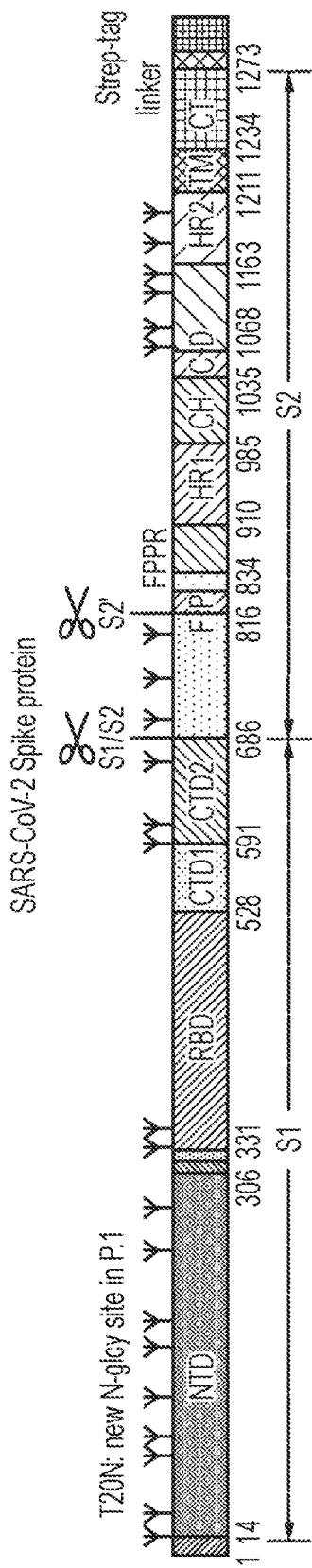
FIG. 13: Counts of residues within the footprints of 33 neutralizing mAbs, or respectively clusters 13, 4, 10, 2, 1, 3. Listed are residues within the footprint of neutralizing mAbs and/or which are lineage defining mutation positions for B.1.1.7, B.1.351 or P.1 (marked "x"). E.g. K417 and E484 mutations which are amino acid positions in the S-protein are only to be found in the South African and Brazilian lineages.
Figure 14:
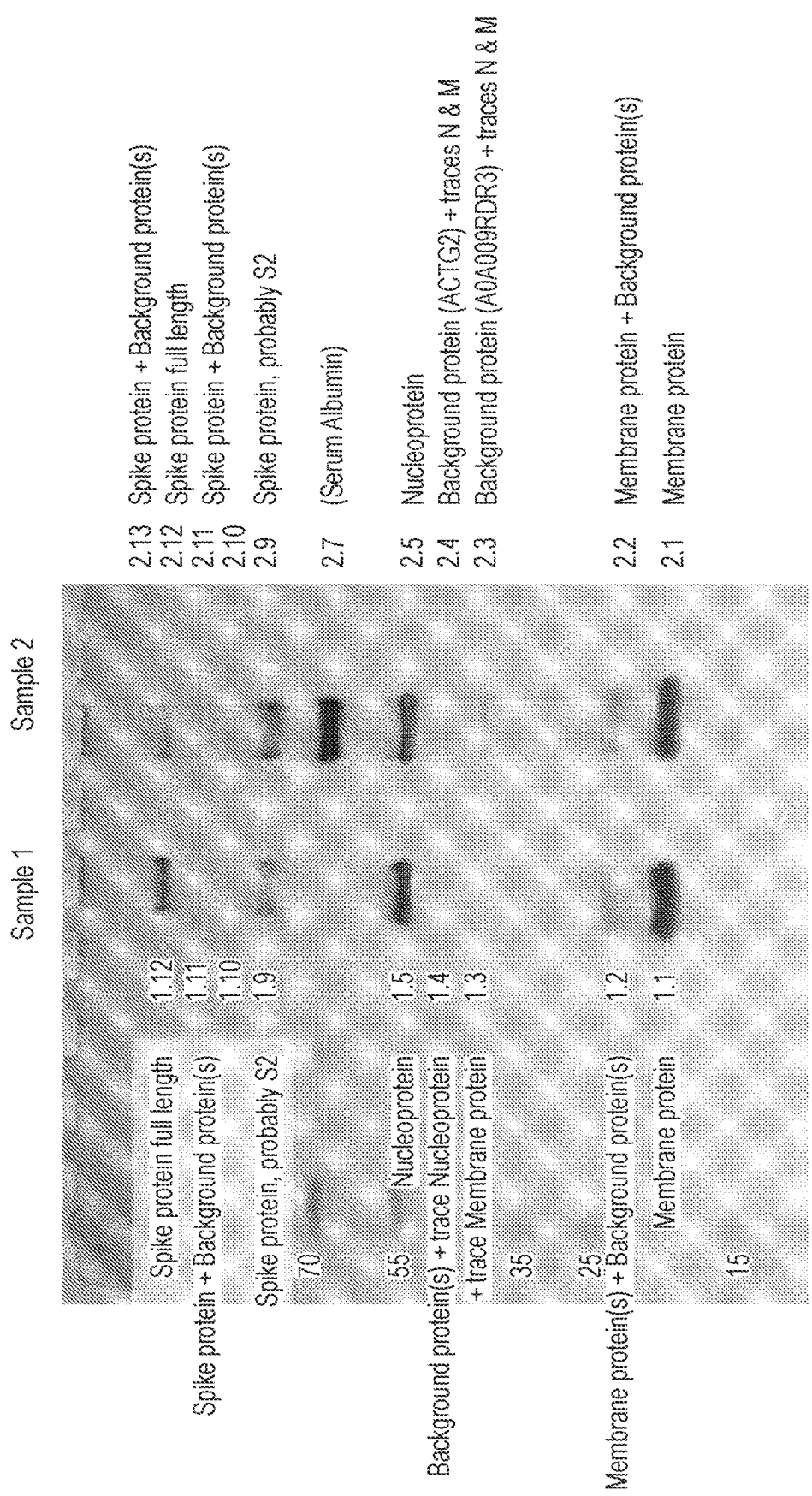
FIG. 14: SDS-PAGE, silver stain, of two samples of SARS-CoV-2 candidates according to example 1 (iCELLIS 500 bioreactor, protamine sulfate precipitated, BPL inactivated). The bands could be clearly attributed to the three main viral proteins (Spike-protein, Membrane-protein, Nucleoprotein) as well as to background proteins from the host system.
Figure 15:
FIG. 15: SARS-CoV-2 Mutations within the Spike Protein of strain UK MIG457 (B.1.1.7 lineage) and strain SA_P2 (B.1.351 lineage) from PHE.
Figure 16A:
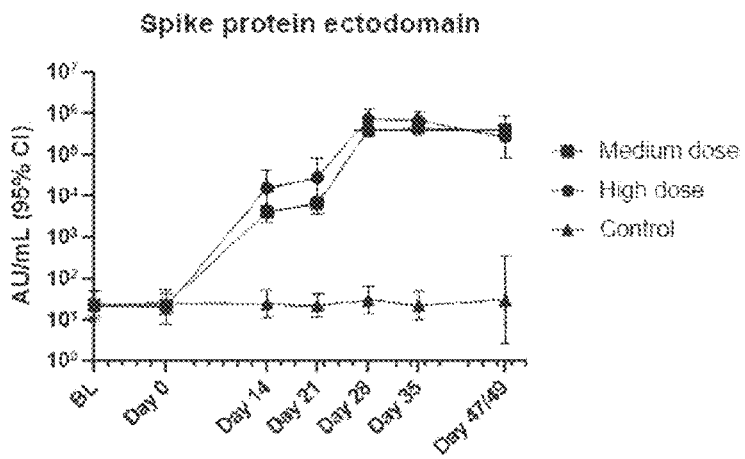
FIG. 16: Immunogenicity of the vaccine candidate in cynomolgus macaques. A) Plates were coated with ectodomain of spike protein with a T4 trimerization domain. B) Plates were coated with receptor binding domain (RBD) of spike glycoprotein. C) Plates were coated with nucleoprotein.
Figure 16B:
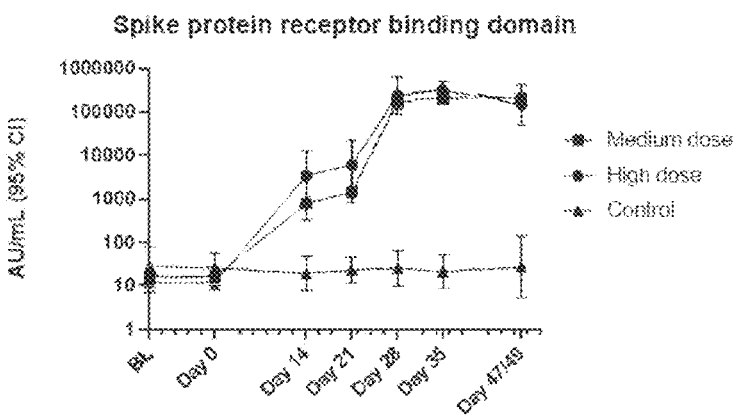
Figure 16C:
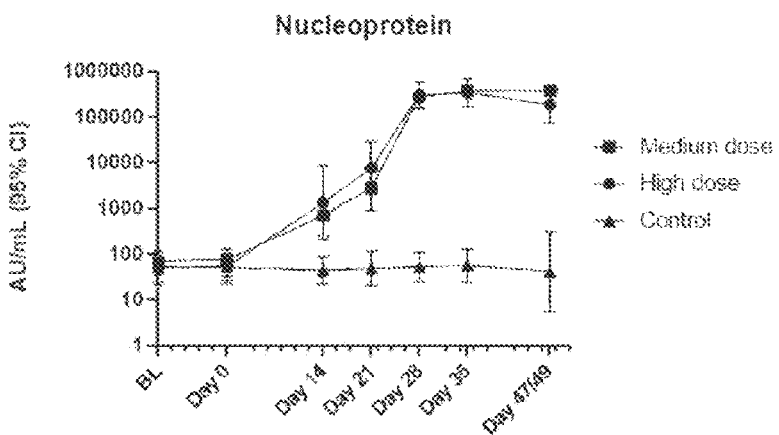
Figure 17:
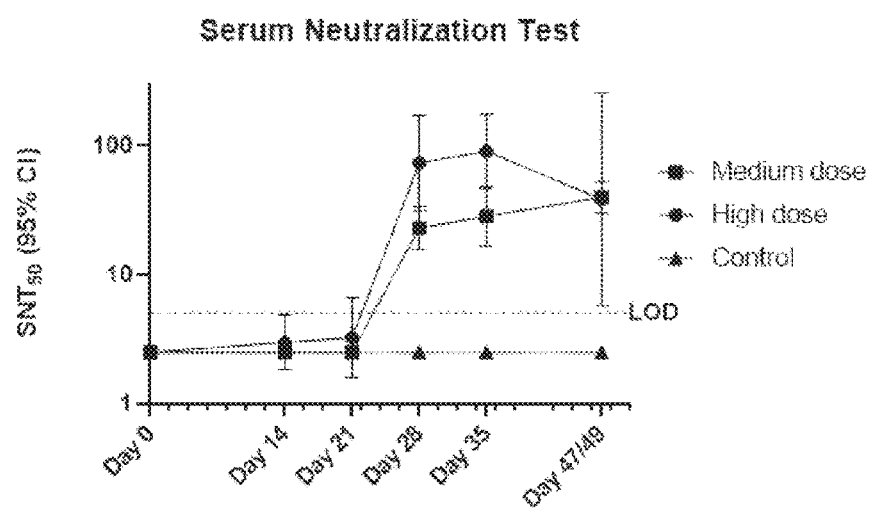
FIG. 17: Neutralizing titers determined by SNT. The dashed line represents the limit of detection (LOD, $SNT_{50}=5$). Samples with a $SNT_{50}$ titer below 5 were imputed to 2.5
Figure 18A:
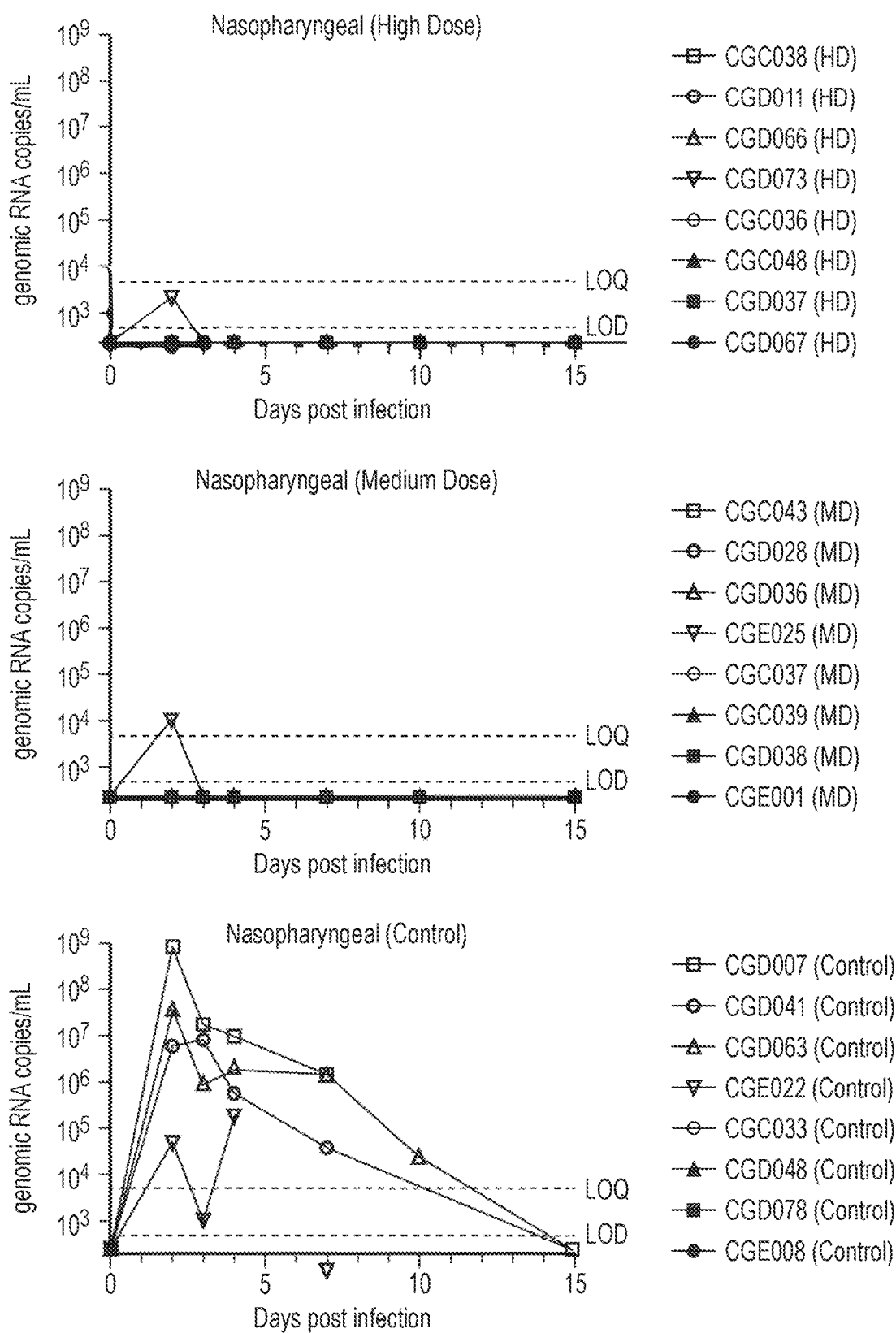
FIG. 18: Genomic copies of SARS-CoV-2 RNA determined by RT-qPCR. A) Nasopharyngeal swabs. B) Tracheal swabs. The dashed lines represent the limit of detection (LOD=476 RNA copies/mL) and limit of quantification (LOQ=4760 RNA copies/mL). Samples with RNA copies/mL below 476 were imputed to 238.
Figure 18B:
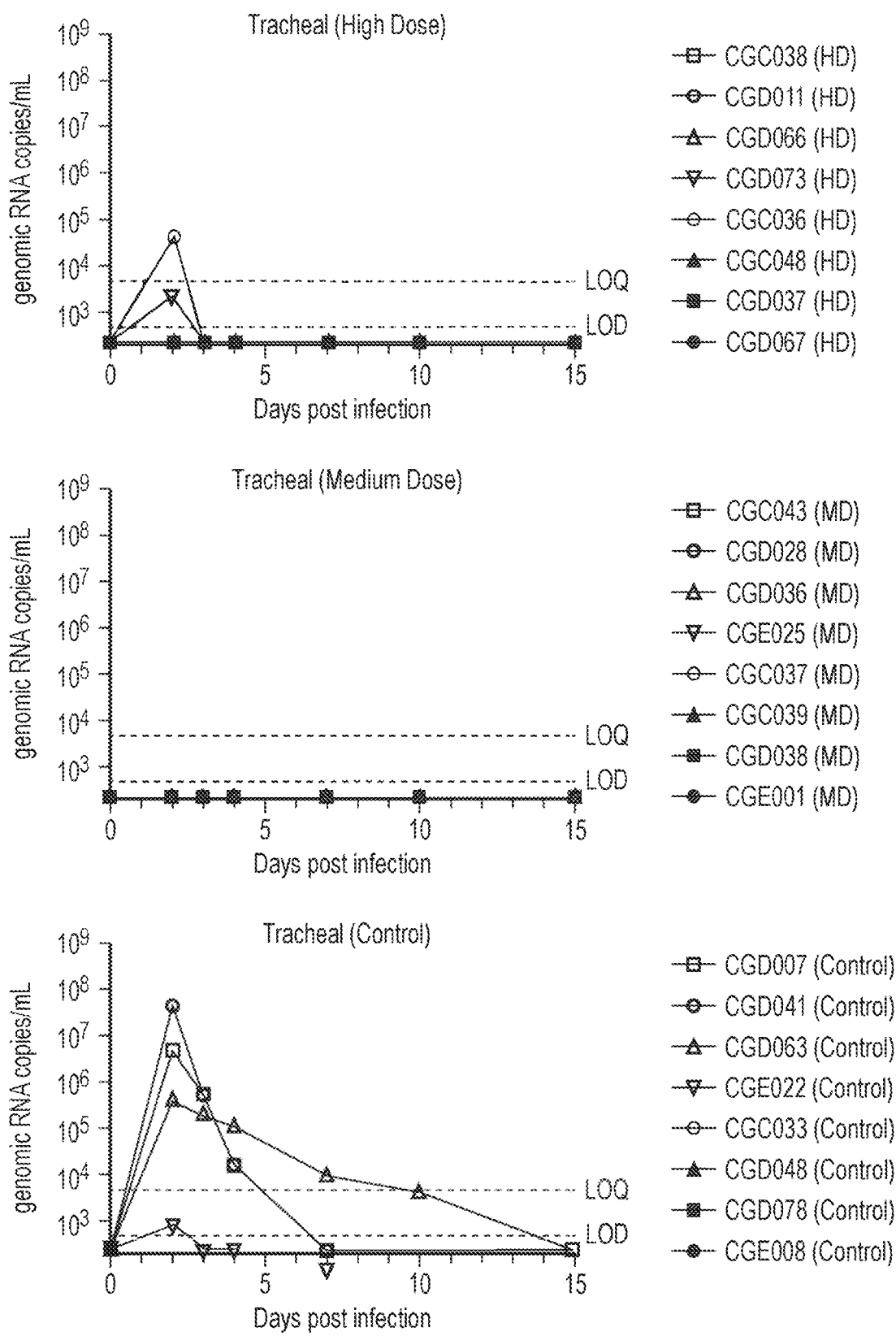
Figure 19A:
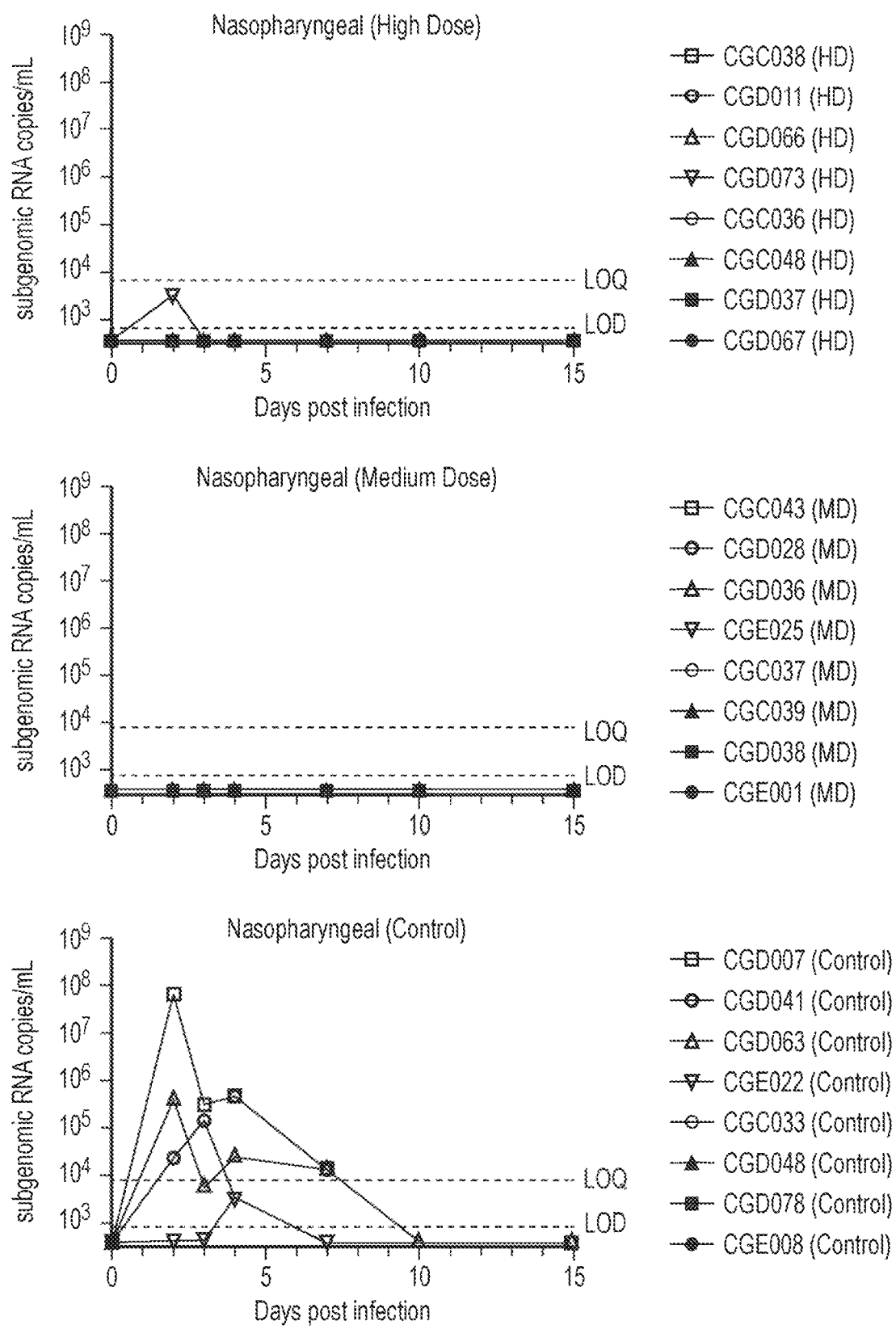
FIG. 19: Subgenomic copies of SARS-CoV-2 RNA determined by RT-qPCR. A) Nasopharyngeal swabs. B) Tracheal swabs. The dashed lines represent the limit of detection (LOD=749 RNA copies/mL) and limit of quantification (LOQ=7490 RNA copies/mL). Samples with RNA copies/mL below 749 were imputed to 375.
Figure 19B:
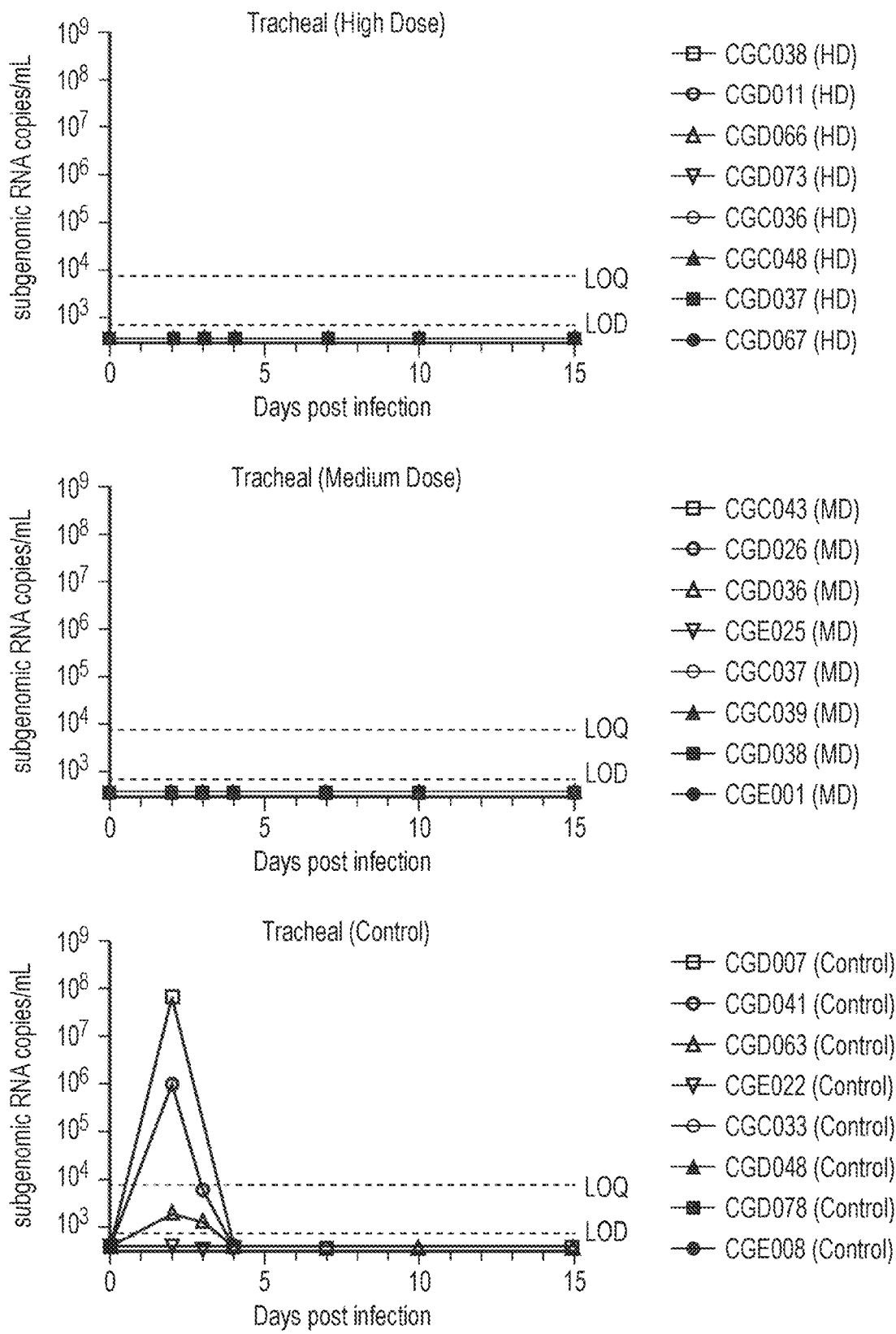
Figure 20B:
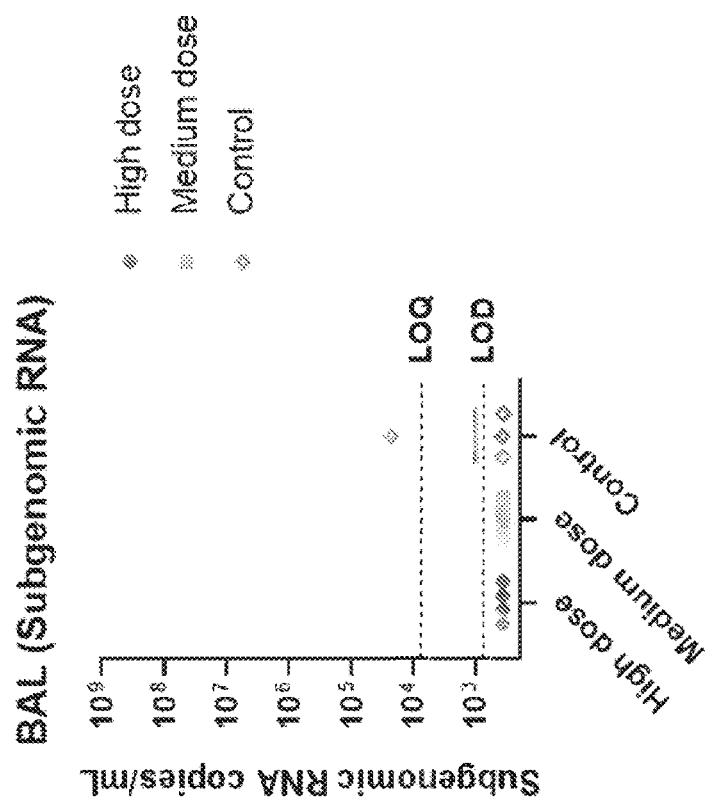
FIG. 20: Analyses of bronchoalveolar lavage by RT-qPCR. A) Genomic RNA, samples with RNA copies/mL below 476 (LOD) were imputed to 238. B) Subgenomic RNA, samples with RNA copies/mL below 749 (LOD) were imputed to 375. The dashed lines represent the limit of detection (LOD) and limit of quantification (LOQ) in the respective assays.
Figure 20A:
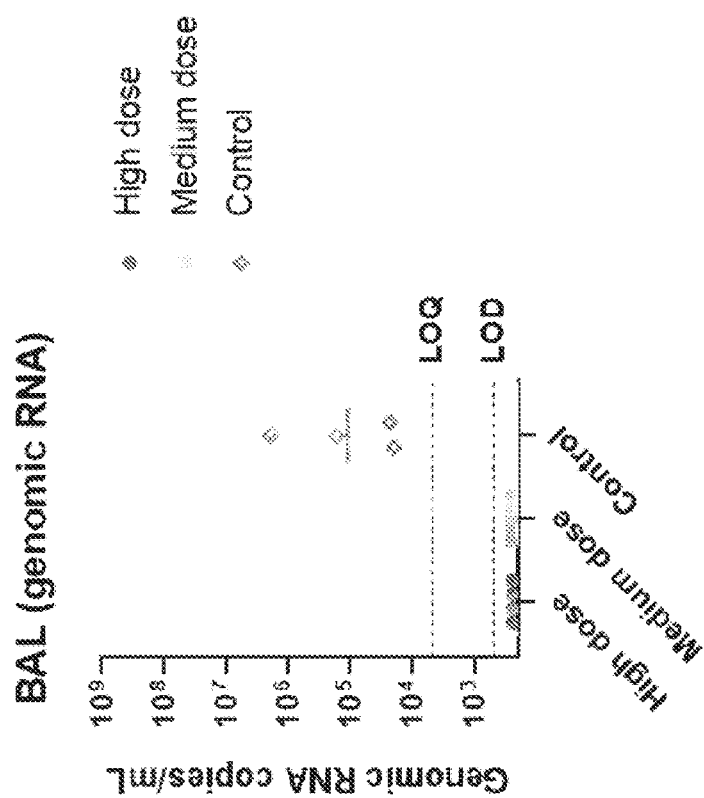

In a preferred embodiment, the amount of antigen in the SARS-CoV-2 vaccine is determined by ELISA. In one embodiment, the ELISA measures a SARS-CoV-2 protein or portion of a protein, e.g., nucleocapsid (N), membrane (M) or spike (S) protein; i.e., the ELISA utilizes a coating antibody specific to a SARS-CoV-2 protein or portion of a protein. In a preferred embodiment, the coating antibody is specific to the SARS-CoV-2 Spike protein 51 subunit, e.g. residues 14-685 (or 14-683) of the S-protein sequence of SEQ ID NO:3, 19, 21, 23, 25 or 27, or to the Receptor Binding Domain (RBD), e.g. residues 331 to 528 (or 319 to 541) of the S-protein sequence of SEQ ID NO: 3, 19, 21, 23, 25 or 27 (see FIG. 13). In one embodiment, the ELISA readout is a mass per unit measure of the detected protein, e.g. µg/mL S-protein. In a preferred embodiment, the standard used is a spike protein trimer and the results of the SARS-CoV-2 ELISA are reported as "antigen units" (AU), corresponding to the ACE-2 binding ability of the standard protein (determined by the manufacturer).

In one embodiment, the amount of SARS-CoV-2 antigen administered to a subject is between about 1 to 100 AU/dose, preferably between about 2 to 75 AU/dose, preferably between about 3 and 60 AU/dose, more preferably between about 3 and 55 AU/dose, more preferably between about 3 and 53 AU/dose. In an even more preferred embodiment, the amount of SARS-CoV-2 antigen administered to a subject is 3 AU, 10 AU or 40 AU per dose, most preferred 40 AU per dose. In further preferred embodiments, the amount of SARS-CoV-2 antigen administered to a subject is at least 10 AU/dose, at least 20 AU/dose, at least 25 AU/dose or at least 30 AU/dose, e.g. about 10 to 60 AU/dose, 20 to 50 AU/dose, 25 to 45 AU/dose or 30 to 40 AU/dose, e.g. about 35 AU/dose. The amount of SARS-CoV-2 antigen (e.g. in AU/dose) may be assessed, for example, by a SARS-CoV-2 ELISA assay as described in Example 1. It is estimated that there are about 1 to $1.5 \times 10^7$ viral particles per AU, and the amounts of SARS-CoV-2 antigen described above may be construed accordingly. Thus in some embodiments, the amount of SARS-CoV-2 antigen administered to a subject is between about $1.5 \times 10^7$ to $1.5 \times 10^9$ viral particles/dose, or between about $4.5 \times 10^7$ to $9.0 \times 10^8$ viral particles/dose, e.g. at least $1.5 \times 10^8$ viral particles/dose or at least $3.0 \times 10^8$ viral particles/dose, about $1.5 \times 10^8$ to $7.5 \times 10^8$ viral particles/dose or about $4.5 \times 10^8$ to $6.0 \times 10^8$ viral particles/dose.

In some embodiments, seroconversion of a subject is assessed by performing a plaque reduction neutralization test (PRNT). Briefly, PRNT is used to determine the serum titer required to reduce the number of SARS-CoV-2 plaques by 50% ($PRNT_{50}$) as compared to a control serum/antibody. The $PRNT_{50}$ may be carried out using monolayers of Vero cells or any other cell type/line that can be infected with SARS-CoV-2. Sera from subjects are diluted and incubated with live, non-inactivated SARS-CoV-2. The serum/virus mixture may be applied to Vero cells and incubated for a period of time. Plaques formed on the Vero cell monolayers are counted and compared to the number of plaques formed by the SARS-CoV-2 in the absence of serum or a control antibody. As a guideline, a threshold of neutralizing antibodies of 1:10 dilution of serum in a $PRNT_{50}$ is generally accepted as evidence of protection in the case of JEV (Hombach et. al. Vaccine (2005) 23:5205-5211).

In some embodiments, the SARS-CoV-2 particles may be formulated for administration in a composition, such as a pharmaceutical composition. The term "pharmaceutical composition" as used herein means a product that results from the mixing or combining of at least one active ingredient, such as an inactivated SARS-CoV-2, and one or more inactive ingredients, which may include one or more pharmaceutically acceptable excipients. A preferred pharmaceutically acceptable excipient is human serum albumin (HSA), such as, especially recombinant HSA (rHSA). In one embodiment, the SARS-CoV-2 vaccine of the invention contains about 10 to 50 µg HSA/dose, preferably about 20 to 40 µg HSA/dose, more preferably about 25 to 35 µg HSA/dose.

Pharmaceutical compositions of the invention, including vaccines, can be prepared in accordance with methods well-known and routinely practiced in the art (see e.g., Remington: The Science and Practice of Pharmacy, Mack Publishing Co. 20th ed. 2000; and Ingredients of Vaccines—Fact Sheet from the Centers for Disease Control and Prevention, e.g., adjuvants and enhancers as described above to help the vaccine improve its work, preservatives and stabilizers to help the vaccine remain unchanged (e.g., albumin, phenols, glycine)). As used herein, the term "vaccine" refers to an immunogenic composition, e.g. a composition capable of inducing an immune response in a (human) subject against an antigen (e.g. against a SARS-CoV-2 antigen). For instance, the vaccine or composition may be capable of generating neutralizing antibodies against SARS-CoV-2, e.g. as determined in an assay described herein (e.g. a microneutralization assay). In some embodiments, the vaccine or composition is capable of generating antibodies (e.g. IgG) against SARS-CoV-2 S (spike) protein, e.g. as detected by an S-protein IgG ELISA assay as described herein. In some embodiments, the vaccine or composition is capable of generating a T cell response against SARS-CoV-2 proteins or peptides, for instance a T cell response against a SARS-CoV-2 S-protein, membrane (M) protein and/or nucleocapsid (N) protein or peptides derived therefrom, e.g. as detected by an ELISPOT assay as described herein (e.g. based on IFN-γ production). Preferably the vaccine or immunogenic composition generates neutralizing antibodies and a T cell response against SARS-CoV-2. Typically the vaccine or immunogenic composition is capable of inducing a protective effect against a disease caused by the antigen, e.g. a protective effect against SARS-CoV-2 infection (e.g. symptomatic and/or asymptomatic infection) and/or COVID-19 disease).

Pharmaceutical compositions are preferably manufactured under GMP conditions. Typically, a therapeutically or prophylactically effective dose of the inactivated SARS-CoV-2 vaccine preparation is employed in the pharmaceutical composition of the invention. The inactivated SARS-CoV-2 particles are formulated into pharmaceutically acceptable dosage forms by conventional methods known to those of skill in the art. Dosage regimens are adjusted to provide the optimum desired response (e.g., the prophylactic response).

Dosages of the active ingredients in the pharmaceutical compositions of the present invention can be varied so as to obtain an amount of the active ingredient which is effective to achieve the desired pharmaceutical response for a particular subject, composition, and mode of administration, without being toxic to the subject. The selected dosage level depends upon a variety of pharmacokinetic factors, including the activity of the particular compositions of the present invention employed, the route of administration, the time of administration, the rate of excretion of the particular compound being employed, the duration of the treatment, other drugs, compounds and/or materials used in combination with the particular compositions employed, the age, sex, weight, condition, general health and prior medical history of the subject being treated, and like factors.

A physician, veterinarian or other trained practitioner, can start dosing of the inactivated SARS-CoV-2 vaccine employed in the pharmaceutical composition at levels lower than that required to achieve the desired therapeutic or prophylactic effect and gradually increase the dosage until the desired effect (e.g., production of anti-SARS-CoV-2 virus antibodies) is achieved. In general, effective doses of the compositions of the present invention, for the prophylactic treatment of groups of people as described herein vary depending upon many different factors, including means of administration, target site, physiological state of the patient, whether the patient is human or an animal, other medications administered, and the titer of anti-SARS-CoV-2 antibodies desired. Dosages need to be titrated to optimize safety and efficacy. In some embodiments, the dosing regimen entails subcutaneous or intramuscular administration of a dose of inactivated SARS-CoV-2 vaccine twice, once at day 0 and once at about day 7. In some embodiments, the dosing regimen entails subcutaneous administration of a dose of inactivated SARS-CoV-2 vaccine twice, once at day 0 and once at about day 14. In some embodiments, the dosing regimen entails subcutaneous administration of a dose of inactivated SARS-CoV-2 vaccine twice, once at day 0 and once at about day 21. In some embodiments, the dosing regimen entails subcutaneous administration of a dose of inactivated SARS-CoV-2 vaccine twice, once at day 0 and once at about day 28. In some embodiments, the inactivated SARS-CoV-2 vaccine is administered to the subject once. In a preferred embodiment, the SARS-CoV-2 vaccine is administered to the subject more than once, preferably two times.

In a preferred embodiment, the vaccine is administered on day 0 and day 21. In another preferred embodiment, the vaccine is administered on day 0 and day 28.

In further embodiments, a first (prime) dose of the inactivated SARS-CoV-2 vaccine is administered and a second (boost) dose of the inactivated SARS-CoV-2 vaccine is administered at least 28 days, at least 60 days, at least 70 days, at least 80 days or 90 days after the first dose. Thus in some embodiments, the second dose of the inactivated SARS-CoV-2 vaccine is administered 30 to 120 days or 1 to 4 months (preferably about 3 months) after the first dose.

In other embodiments, the inactivated SARS-CoV-2 vaccine is administered as a booster dose only, e.g. a first (prime) dose of a (different) SARS-CoV-2 vaccine is administered and then a second (boost) dose of the inactivated SARS-CoV-2 vaccine is administered, e.g. at least 7, 14, 28, 60 or 90 days after the first dose. The first (prime) dose of the SARS-CoV-2 vaccine may comprise any other vaccine or immunogenic composition that stimulates an immune response and/or a protective effect in subjects against SARS-CoV-2 virus. For example, the first dose of SARS-CoV-2 vaccine may comprise a recombinant viral vector or an mRNA sequence encoding one or more SARS-CoV-2 proteins and/or fragments thereof, e.g. a SARS-CoV-2 spike (S) protein. Alternatively the first dose of SARS-CoV-2 vaccine may comprise a subunit vaccine, e.g. comprising one or more SARS-CoV-2 proteins and/or fragments thereof, e.g. a SARS-CoV-2 spike (S) protein or fragment thereof.

Also within the scope of the present disclosure are kits for use in prophylactic administration to a subject, for example to prevent or reduce the severity of SARS-CoV-2 infection. Such kits can include one or more containers comprising a composition containing inactivated SARS-CoV-2, such as an inactivated SARS-CoV-2 vaccine. In some embodiments, the kit may further include one or more additional components comprising a second composition, such as a second vaccine, e.g. a second kind of SARS-CoV-2 vaccine that applies a different technology than in the first dose. In some embodiments, the second vaccine is a vaccine for an arbovirus. In some embodiments, the second vaccine is a Japanese encephalitis virus vaccine, a Zika virus vaccine, a Dengue virus vaccine and/or a Chikungunya virus vaccine.

In some embodiments, the kit comprises instructions for use in accordance with any of the methods described herein. The included instructions may comprise a description of administration of the composition containing inactivated SARS-CoV-2 vaccine to prevent, delay the onset of, or reduce the severity of SARS-CoV-2 infection. The kit may further comprise a description of selecting a subject suitable for administration based on identifying whether that subject is at risk for exposure to SARS-CoV-2 or contracting a SARS-CoV-2 infection. In still other embodiments, the instructions comprise a description of administering a composition containing inactivated SARS-CoV-2 vaccine to a subject at risk of exposure to SARS-CoV-2 or contracting SARS-CoV-2 infection.

The instructions relating to the use of the composition containing inactivated SARS-CoV-2 vaccine generally include information as to the dosage, dosing schedule, and route of administration for the intended treatment. The containers may be unit doses, bulk packages (e.g., multi-dose packages) or sub-unit doses. Instructions supplied in the kits of the invention are typically written instructions on a label or package insert (e.g., a paper sheet included in the kit), but machine-readable instructions are also acceptable.

The kits of the present disclosure are in suitable packaging. Suitable packaging includes, but is not limited to, vials, bottles, jars, flexible packaging, and the like. Also contemplated are packages for use in combination with a specific device, such as a syringe or an infusion device. The container may have a sterile access port, for example the container may be a vial having a stopper pierceable by a hypodermic injection needle. At least one active agent in the composition is an inactivated SARS-CoV-2, as described herein.

This invention is not limited in its application to the details of construction and the arrangement of components set forth in the following description or illustrated in the drawings. The invention is capable of other embodiments and of being practiced or of being carried out in various ways. Also, the phraseology and terminology used herein is for the purpose of description and should not be regarded as limiting. The use of "including", "comprising", or "having", "containing", "involving", and variations thereof herein, is meant to encompass the items listed thereafter and equivalents thereof as well as additional items.

Unless otherwise defined herein, scientific and technical terms used in connection with the present disclosure shall have the meanings that are commonly understood by those of ordinary skill in the art. Further, unless otherwise required by context, singular terms shall include pluralities and plural terms shall include the singular. The methods and techniques of the present disclosure are generally performed according to conventional methods well-known in the art. Generally, nomenclatures used in connection with, and techniques of biochemistry, enzymology, molecular and cellular biology, microbiology, virology, cell or tissue culture, genetics and protein and nucleic chemistry described herein are those well-known and commonly used in the art. The methods and techniques of the present disclosure are generally performed according to conventional methods well-known in the art and as described in various general and more specific references that are cited and discussed throughout the present specification unless otherwise indicated.

The present invention is further illustrated by the following examples, which in no way should be construed as further limiting. The entire contents of all of the references (including literature references, issued patents, published patent applications, and co-pending patent applications) cited throughout this application are hereby expressly incorporated by reference, in particular for the teaching that is referenced hereinabove. However, the citation of any reference is not intended to be an admission that the reference is prior art.

EXAMPLES

Example 1. Drug Substance Production

For the production of SARS-CoV-2, the JEV process platform (Srivastava et al., Vaccine 19 (2001) 4557-4565; U.S. Pat. No. 6,309,650B1) was used as a basis, also taking into account improvements in the process as adapted to Zika virus purification as disclosed in WO2017/109223A1 (which is incorporated herein in its entirety). Briefly, non-infectious SARS-CoV-2 particle aggregates, HCP and other LMW impurities are removed by protamine sulfate precipitation or benzonase treatment and the resulting preparation is optionally further purified by sucrose gradient centrifugation. See FIG. 1 for an outline of the production process.

The first SARS-CoV-2 isolate from Italy, identified and characterized at the National Institute for Infectious Diseases "Lazzaro Spallanzani" IRCCS, Rome, Italy (Accession No: MT066156), the RNA sequence thereof corresponding to the DNA sequence provided by SEQ ID NO: 9, was used in all Examples disclosed herein. Other novel coronavirus SARS-CoV-2 isolates may also be obtained from the following sources:

1. —EVAg (European Virus Archive), e.g. one of the following strains:
BetaCoV/France/IDF0372/2020 (Ref-SKU:014V-03890, www.european-virus-archive.com/virus/human-2019-ncov-0); 2019-nCoV/Italy-INMI1, (Ref-SKU:008V-03893, SEQ ID NO: 9; www.european-virus-archive.com/virus/human-2019-ncov-strain-2019-ncovitaly-inmi1); BetaCoV/Netherlands/01, (Ref-SKU: 010V-03903, www.european-virus-archive.com/virus/sars-cov-2-strain-nl-2020)
2. —BEI Resources (Biodefense and Emerging Infections Research Resources): e.g. Isolate USA-WA1/2020, NIAID, NIH: SARS-Related Coronavirus 2, NR-52281 (GenBank accession MN985325).
3. —PHE (Public Health England): www.gov.uk/government/collections/contacts-public-health-england-regions-local-centres-and-emergency: e.g. isolate of UK B.1.1.7 (UK_MIG457:

EVAg Ref-SKU: 004V-04032; SEQ ID NO: 22) or South African B.1.531 (SA_P2: EVAg Ref-SKU: 004V-04071; SEQ ID NO: 18) lineage Cell buildup and infection with SARS-CoV-2 The Vero cells used in the methods described herein were the VERO (WHO) cell line, obtained from the Health Protection Agency general cell collection under catalogue number 88020401, from which a master cell bank was generated. A research viral seed bank (rVSB) of SARS-CoV-2 (strain used 2019-nCoV/Italy-INMI1) was prepared following two rounds of plaque purification on Vero cells and the genomic sequence was checked by sequencing. For production of SARS-CoV-2, Vero cells were grown in Eagle's minimal essential medium (EMEM) containing 10% fetal bovine serum (FBS) and monolayers were infected with SARS-CoV-2 at a multiplicity of infection (moi) of 0.01 plaque forming units (pfu) per cell. Alternatively, the moi may be 0.001 to 1, preferably 0.005 to 0.2, preferably 0.01 plaque forming units (pfu) per cell. After allowing virus adsorption, the cultures were washed 2-4 times with PBS, fed with serum-free Opti-Pro and incubated at 35° C. with 5% $CO_2$ until the virus titer reached a desired level.

SARS-CoV-2 harvest The culture medium was harvested at day 3 and harvests and centrifuged in a standard centrifuge. The crude harvest was treated with 0.2 mg/mL Protamine sulfate and filtered (0.8/0.4 μm) followed by incubation at RT° C. for 15-30 minutes. Host cell DNA and protein reduction, as well as reduction of non-infectious virus aggregates in the concentrated material, was achieved by precipitation with protamine sulfate. The clarified harvest was concentrated by TFF ultrafiltration to remove cell culture medium components and reduce batch volume. Alternatively, the diafiltrated SARS-CoV-2 material may be treated with benzonase.

Optional primary inactivation The SARS-CoV-2 virus was inactivated by treatment with beta-propiolactone directly after removal of virus-containing cell culture medium from Vero cells, in order to render the virus safe to handle at BSL2. Inactivation is possible at any stage in the purification process, however, such as e.g., after centrifugation, before, during or after treatment with protamine sulfate or benzonase or before or after sucrose gradient centrifugation. Inactivation may be carried out by the use of a chemical inactivation agent such as formaldehyde (formalin); enzyme; beta-propiolactone; ethanol; trifluroacetic acid; acetonitrile; bleach; urea; guanidine hydrochloride; tri-n- butyl phosphate; ethylene-imine or a derivative thereof; an organic solvent, optionally Tween, Triton, sodium deoxycholate, or sulfobetaine; or a combination thereof. It is particularly preferred that inactivation is carried out using beta-propiolactone, which preferentially targets viral RNA whilst relatively sparing viral surface proteins and their immunogenic epitopes. Inactivation may also be achieved by pH changes (very high or very low pH), by heat treatment or by irradiation such as gamma irradiation or UV irradiation, particularly UV-C irradiation. The SARS-CoV-2 virus may be optionally inactivated by two separate inactivation steps, such as, e.g. beta-propiolactone treatment and UV-C irradiation.

Evaluation of BPL Starting Concentration for Inactivation of a Highly Resistant Model Virus PPV A preliminary study for evaluation of PPV virus inactivation kinetic was conducted to initially support our proposed SARS-CoV-2 BPL inactivation procedure. Porcine Parvovirus (PPV) was selected as a model virus to evaluate the inactivation capability of BPL in aqueous solution because of its high resistance to physico-chemical inactivation. Three starting concentrations of BPL were evaluated, 300 ppm (1/3333), 500 ppm (1/2000) and 700 ppm (1/1429). Virus solution was spiked with BPL at these concentrations and incubated at 5±2° C. for 24 hours. Kinetic samples were taken at 0.5, 2, 6, 24 h and after the BPL hydrolyzation step and analysed for remaining infectivity. The results are shown in Table A.

TABLE A

Summary of virus titers and reduction factors for PPV inactivation by BPL concentration [ppm]

|  | 300 | 500 | 700 |
| --- | --- | --- | --- |
| titer w/o BPL [TCID50/mL] | 9.97 | 10.04 | 9.98 |
| titer 24 h incubation [TCID50/mL] | 6.66 | 4.98 | 4.1 |
| titer after hydrolysis [TCID50/mL] | 5.1 | 2.6 ** | <LOD.* |
| reduction factor after hydrolysis | 4.84 ± 0.39 | 7.43 ± 0.92 | ≥6.89 ± 0.23 |

*below limit of detection
** Note limit of detection for 500 ppm BPL is lower than for 700 ppm BPL A clear effect of initial BPL concentration on the inactivation effectivity was observed with a reduction between 3.3 and 5.9 log 10 after 24 h incubation at 5±2° C. (before hydrolysis). The following hydrolysis step further reduced the titers by on average addition 1.7 log 10 while the hold control titers remained constant throughout the whole procedure. This indicated that for highly resistant virus contaminations the hydrolysis step might serve as an additional inactivation step.

With overall reduction factors of 4.84 (300 ppm), 7.43 (500 ppm) and below the limit of detection (700 ppm) the applied BPL treatment was considered effective for the inactivation of Parvoviridae at concentrations >300 ppm.

Therefore, we decided to select 500 ppm for SARS-CoV-2 virus inactivation in all further studies.

SARS-CoV-2 Virus Inactivation by BPL

Based on existing data on the inactivation of model viruses by BPL (see section above on PPV inactivation) a BPL concentration of 500 ppm (1/2000) was selected for the inactivation of SARS-CoV-2 virus harvest material. As the stability of BPL in solutions is highly temperature dependent an incubation temperature of 5±3° C. and an incubation time of 24 hours were selected to ensure enough BPL present throughout the whole inactivation. After addition and mixing of BPL to the concentrated harvest, the inactivation solution is transferred to a fresh container where the inactivation takes place under controlled conditions. This transfer excludes the possibility of virus particles in potential dead-spots during initial mixing not being in contact with BPL.

To stabilize the pH of the inactivated viral solution during hydrolysis of the BPL, protamine sulfate (PS) treated concentrated harvest pre-cooled to 5±3° C. is supplemented with 25 mM HEPES pH 7.4.

To reduce remaining BPL after the inactivation the solution is warmed to temperatures above 32° C. for a total time of 2.5 hours±0.5 hours in a temperature-controlled incubator set to 37±2° C. The total time of the hydrolyzation step for the current process volume of about 1 L was between 5 hours 15 minutes and 6 hours 15 minutes including the warming to and the incubation above 32° C.

After completion of the hydrolysis, the inactivated viral solution (IVS) was immediately cooled down to 5±3° C. in a temperature-controlled fridge and stored there until inactivation was confirmed by large volume plaque assay and serial passaging assay which currently requires 18 days in total.

Recovery of virus particles throughout the inactivation process was monitored by size-exclusion chromatography.

Initial studies at lab-scale from 15 mL up to 1000 mL indicated a very fast inactivation kinetic for SARS-CoV-2 where virus titers of up to 8 log 10 pfu/mL were reduced below detectable levels within 2 hours after BPL addition. These results were confirmed for GMP production runs at a final inactivation volume of approximately 1 L.

Taken together with the inactivation data for model viruses the applied BPL treatment can be considered efficient and includes a significant safety margin for inactivation of SARS-CoV-2 concentrated harvest material.

In a further preferred embodiment, the inactivation step(s) are particularly gentle, in order to preserve surface antigen integrity, especially integrity of the S protein. In one embodiment, the gentle inactivation method comprises contacting a liquid composition comprising SARS-CoV-2 particles with a chemical viral inactivating agent (such as e.g. any of the chemical inactivation agents as listed above or a combination thereof, preferably beta-propiolactone) in a container, mixing the chemical viral inactivating agent and the liquid composition comprising SARS-CoV-2 particles under conditions of laminar flow but not turbulent flow, and incubating the chemical viral inactivating agent and the liquid composition comprising SARS-CoV-2 particles for a time sufficient to inactivate the viruses. The gentle inactivation step is optionally performed in a flexible bioreactor bag. The gentle inactivation step preferably comprises five or less container inversions during the period of inactivation. Preferably, the mixing of the chemical viral inactivating agent and the composition comprising SARS-CoV-2 particles comprises subjecting the container to rocking, rotation, orbital shaking, or oscillation for not more than 10 minutes at not more than 10 rpm during the period of incubation.

Purification of SARS-CoV-2 Optionally, the material was immediately further processed by batch adsorption (also known herein as batch chromatography) with CAPTO™ CORE 700 (CC700) or CC400 chromatography media having a ligand-activated core and inactive shell at a final concentration of ~1% CC700 or CC400. The material was incubated at 4° C. for 15 minutes under constant agitation using a magnetic stirrer. After incubation, if used, the CC700 or CC400 solid matter was allowed to settle by gravity for 10 minutes and the SARS-CoV-2 material is removed from the top of the solution in order to avoid blockage of the filter by CAPTO™ CORE particles. Any remaining CAPTO™ CORE particles and DNA precipitate were then removed from the solution by filtration using a 0.2 µm Mini KLEEN-PAK® EKV filter capsule (Pall). The filtered harvest material was adjusted to a final concentration of 25 mM Tris pH 7.5 and 10% sucrose (w/w) using stock solutions of both components. This allowed for freezing the concentrated harvest at <−65° C. if required.

The resulting filtrate was further processed by sucrose density gradient centrifugation (also known herein as batch centrifugation) for final concentration and polishing of the SARS-CoV-2 material. The concentrated protamine sulfate (PS) or benzonase treated (preferred is PS treated) harvest is loaded on top of a solution consisting of three layers of sucrose with different densities. The volumes of individual layers for a centrifugation in 100 mL bottle scale are shown in Table 1.

TABLE 1

Volumes for sucrose density centrifugation.

| Sucrose solution (w/w) | Volume (mL) |
|---|---|
| PS-treated SARS-CoV-2 harvest (10% sucrose) | 40 |
| 15% sucrose | 15 |
| 35% sucrose | 15 |
| 50% sucrose | 20 |
| Total volume | 90 |

Figure 3:
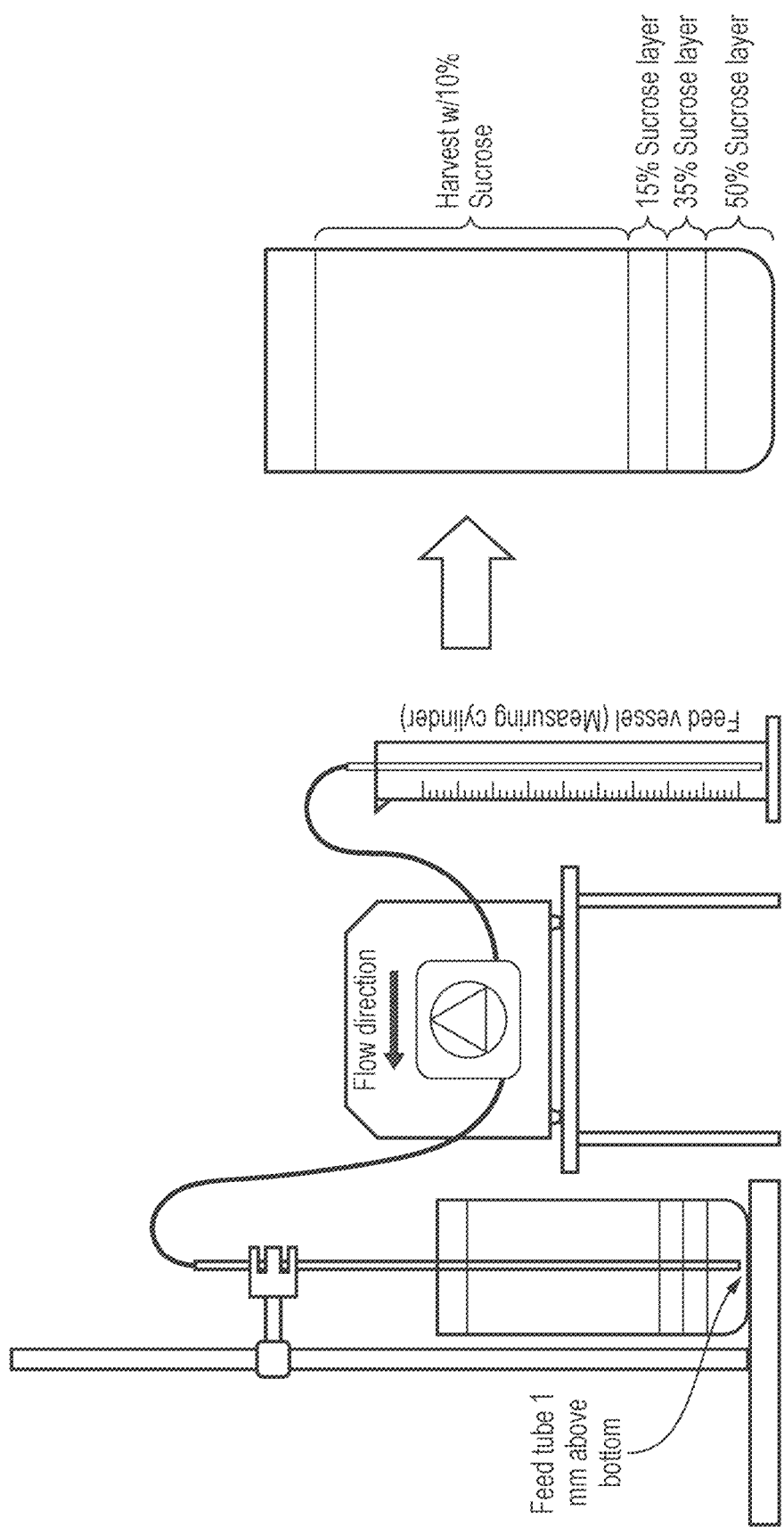
FIG. 3. A preferred set-up for the sucrose gradient centrifugation used as a polishing step for the SARS-CoV-2 vaccine of the invention.

The sucrose gradient bottles are prepared by stratifying the individual sucrose layers by pumping the solutions into the bottom of the bottles, starting with the SARS-CoV-2 material with the lowest sucrose density (10% sucrose (w/w)), followed by the other sucrose solutions in ascending order. The described setup is shown in FIG. 3. The prepared SG bottles are transferred into a rotor pre-cooled to 4° C. and centrifuged at ~11,000 RCF max at 4° C. for at least 20 hours, without brake/deceleration.

After centrifugation, harvest of serial 2 mL fractions of the sucrose gradient was performed from the bottom up with a peristaltic pump. The fractions were immediately tested by SDS-PAGE/silver staining to identify virus-containing fractions with sufficiently high purity. Thus, identified fractions were pooled and further processed. The purified SARS-CoV-2 was stored at <−65° C. or immediately formulated.

Formulation of SARS-CoV-2 with adjuvant CpG, and optionally alum, were added to the SARS-CoV-2 composition and/or prepared in a separate vial for bedside mixing.

SARS-CoV-2 ELISA Assay Inactivated SARS-CoV-2 antigen content (i.e. content of S1 as the major antigenic protein) in preparations described herein was determined (quantified) by ELISA. The SARS-CoV-2 ELISA used herein is a four-layer immuno-enzymatic assay with a SARS-CoV-2 spike antibody (AM001414; coating antibody) immobilized on a microtiter plate to which the SARS-CoV-2 sample was added. On binding of the antigen to the coating antibody, the plate was further treated with primary antibody (i.e. ABFLEX®SARS-COV-2 spike antibody (rAb) (AM002414)). This was followed by addition of the secondary antibody, which is an enzyme linked conjugate antibody (i.e. Goat anti-Mouse IgG HRP Conjugate). The plates were washed between various steps using a mild detergent solution (PBS-T) to remove any unbound proteins or antibodies. The plate was developed by addition of a tetramethyl benzidine (TMB) substrate. The hydrolyzed TMB forms a stable colored conjugate that is directly proportional to the concentration of antigen content in the sample. The antigen quantification was carried out by spectrophotometric detection at $\lambda 450$ nm ($\lambda 630$ nm reference) using the standard curve generated in an automated plate reader as a reference. Standards were prepared starting with a 20 antigen units (AU)/mL spike trimer working solution neat, which was further serially diluted 1:2 for the following standard concentrations: 20 AU/mL, 10 AU/mL, 5 AU/mL, 2.5 AU/mL, 1.25 AU/mL, 0.625 AU/mL, 0.3125 AU/mL and 0.1263 AU/mL. Each dilution was tested in duplicate per plate. An "antigen unit" of the spike trimer standard, according to the supplier (R&D Systems), corresponds to its binding ability in a functional ELISA with Recombinant Human ACE-2 His-tag.

Reference Standards and Antibodies:
Coating Antibody: SARS-CoV-2 Spike Antibody (AM001414)
Spike Trimer (S1+S2), His-tag (SARS-CoV-2) (e.g. BPS Lot #200826; Cat #100728)
SARS-CoV-2 QC (e.g. RSQC240920AGR)
Primary Detection Antibody ABFLEX® SARS-CoV-2 Spike Antibody (rAb) (AM002414)
Secondary Detection Antibody Goat anti-Mouse IgG HRP Conjugate
Coating buffer: Carbonate buffer
ELISA wash buffer: PBS+0.05% Tween-20 (PBS-T).
Sample dilution buffer: PBS-T+1% BSA.

Figure 7:
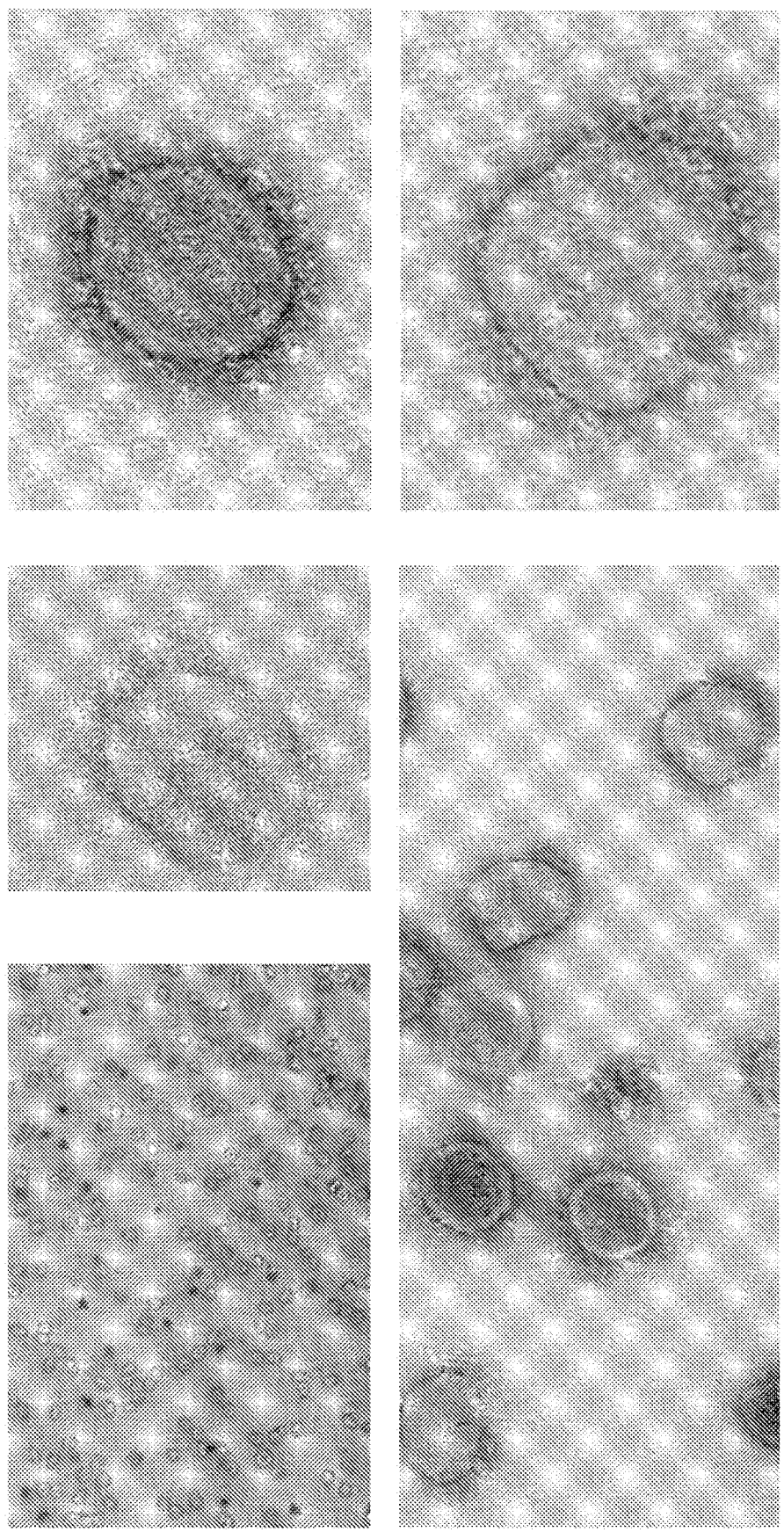
FIG. 7. Production process delivers high density and intact spike proteins. Shown are electron micrographs of the SARS-CoV-2 inactivated drug substance produced according to Example 1. About 1-1.5 $10^7$ viral particles per AU.

Production process delivered high density and intact spike proteins (see FIG. 7). Estimated were about 1 to $1.5 \times 10^7$ viral particles per AU. Inactivation process by beta-propiolactone provided for a fast inactivation kinetic and no detectable chemical modification of the S-protein. Key parameters and relevant process related impurities were similar to the commercial IXIARO® production process (see Table 1b). SARS-CoV-2 drug substance according to the invention was highly pure (>95%) according to SDS-PAGE (silver stain, reduced) and free from aggregates (monomer virus (>95%) according to SE-HPLC (see FIG. 8).

Further confirmatory studies aimed at characterizing modifications of S-protein following beta-propiolactone-inactivated SARS-CoV2 are carried out by mass spectrometric analysis of tryptic digests of the S-protein. The modification of amino acids in important epitopes is minimal. Initial alignment of receptor binding domains (RBD) within the S protein and hACE2 interfaces and epitopes of several known (cross)-neutralizing antibodies (SARS-CoV and SARS-CoV-2) have shown no amino acids within these epitopes with potential high conversion and only few with potential lower conversion rates.

TABLE 1b

Comparison of key parameters and relevant process related impurities of the SARS-CoV-2 drug substance and IXIARO ® drug substance.

| | SARS-CoV-2 | IXIARO |
|---|---|---|
| Viral yield at harvest ($\log_{10}$ PFU/mL) | >7.8 | >7.3 |
| Residual host cell protein (HCP) (ng/mL) | <150 | <100 |

TABLE 1b-continued

Comparison of key parameters and relevant process related impurities of the SARS-CoV-2 drug substance and IXIARO ® drug substance.

| | SARS-CoV-2 | IXIARO |
|---|---|---|
| Residual host cell DNA (hcDNA) (pg/mL) (LOQ 40 pg/mL) | <LOQ | <LOQ |
| Virus Monomer by SEC-MALLS (%) | >95 | >95 |
| Residual Protamine sulfate* (µg/mL) (LOQ 2 µg/mL) | <LOQ | <LOQ |
| Endotoxins (EU/mL) | <0.05 | <0.05 |
| Residual Inactivation reagent | <LOQ (LOQ 1 ppm, β-Propiolactone) | <LOQ (LOQ 50 ppm, Formalin) |

Example 2. In Vitro and In Vivo Assessment of Immunogenicity and Protective Capacity of Inactivated CoV-2 Virus and Adjuvanting/Dose-Sparing Effects of CpG Immunogenicity Prior to immunization, experimental groups of 10 BALB/c mice were bled and pre-immune sera are prepared. The mice are administered a dose titration of inactivated SARS-CoV-2 formulated with alum or alum and CpG 1018 subcutaneously (see Table 2). At two different intervals after immunization (see below), blood was collected and immune sera prepared, spleens were collected at the final bleed. All animal experiments were carried out in accordance with Austrian law (BGB1 Nr. 501/1989) and approved by "Magistratsabteilung 58". Sera were assessed for total IgG and subclasses (IgG1/IgG2a) by ELISA and neutralizing antibodies by PRNT. Th1/Th2 responses were further assessed by IFN-γ ELISpot and intracellular cytokine staining (CD4$^+$/CD8$^+$).

Schedule 1: Immunizations Day 0/Day 7, interim bleed Day 14, final bleed and spleen harvest Day 28

Schedule 2 Immunizations Day 0/Day 21, interim bleeds Day 14/Day 28 and final bleed and spleen harvest Day 35

TABLE 2

Design of dosing experiments, 10 mice/group: 3 dosage groups, first set of experiments (A) with higher dosages ranging from 0.1-1 mAU, second set of experiments (B) with lower dosages ranging from 0.05-0.5 mAU. (Total viral protein/mAU was estimated to be approximately 2 µg/ml).

| | Adjuvants (mice/group) | |
|---|---|---|
| Inactivated SARS-CoV-2 dosages (A/B) | Aluminium hydroxide (50 µg) | Aluminium hydroxide (50 µg)/CpG 1018 (10 µg) |
| (1/0.5 mAU*) | 10 | 10 |
| (0.5/0.2 mAU) | 10 | 10 |
| (0.1/0.05 mAU) | 10 | 10 |
| Placebo | 10 | 10 |

*mAU - SE-HPLC peak area per dose equivalent (recorded as milli-absorption units x minutes; mAU)

Plaque reduction neutralization test (PRNT) Each well of a twelve-well tissue culture plate was seeded with Vero cells and incubated 35° C. with 5% $CO_2$ for three days. Serial dilutions from pools of heat-inactivated sera from each treatment group are tested. Each serum preparation was incubated with approximately 50-80 pfu of SARS-CoV-2 at 35° C. with 5% $CO_2$ for 1 hour. The cell culture medium was aspirated from the Vero cells and the SARS-CoV-2/serum mixtures are added to each well. The plates were gently rocked and then incubated for 2 hours at 35° C. with 5% $CO_2$. To each well, 1 mL of a 2% methylcellulose solution containing EMEM and nutrients were added, and the plates were further incubated for 4 days at 35° C. with 5% $CO_2$. The cells were then stained for 1 hour with crystal violet/5% formaldehyde and washed 3 times with deionized water. The plates were air dried and the numbers of plaques in each well manually counted. Alternatively, other methods, such as e.g. $TCID_{50}$ may be applied.

TABLE 3

Design of schedule and longevity experiments. Immunization schedule as for Table 2, but in addition; interim bleeds 2, 6, 10, 14, 18 and 22 weeks after second immunization; end-bleed 26 weeks after second immunization.

| | Adjuvants (mice/group) | |
|---|---|---|
| | Aluminium hydroxide (50 µg/ml) | Aluminium hydroxide (50 µg/ml)/CpG 1018 (10 µg/ml) |
| Vaccine (high dose), s.c | 20 | 20 |
| Placebo, s.c. | 10 | 10 |

Protective capacity The protective capacity of inactivated SARS-CoV-2 is assessed using a SARS-susceptible transgenic mouse expressing a humanized ACE2 protein (Jackson Laboratory) (Tseng, C.-T. K. et al., Severe Acute Respiratory Syndrome Coronavirus Infection of Mice Transgenic for the Human Angiotensin-Converting Enzyme 2 Virus Receptor (2007) *J of Virol* 81:1162-1173) or a NHP model developed for SARS-CoV-2 infection. Groups of animals are immunized subcutaneously (s.c.) with different dosages of inactivated SARS-CoV-2 with or without adjuvant or PBS as a negative control. Three weeks after the last dose, animals are challenged with SARS-CoV-2 and monitored for disease progression and survival. In addition, serum samples are taken in order to determine the neutralizing antibody titers induced by vaccination in a PRNT assay.

TABLE 3A

Design of dosing experiment 4743 using SARS-CoV-2 ELISA-determined dosages.

| Material | SGP rVSB |
|---|---|
| Buffer | PBS |
| AU/mouse | 3.0 |
| | 1.2 |
| | 0.3 |
| $Al^{3+}$/mouse | 17 µg |
| CpG 1018/mouse | 10 µg |
| Immunization | D 0/D 21 |
| Bleeds | D 28/D 35 |

Experiment 4743 Protocol Female BALB/c mice (10 mice/group) were immunized two times s.c. (100 µL) on days 0 and 21 with doses and adjuvants as outlined in Table 3A. The readouts from the experiment were total IgG and subclasses (IgG1/IgG2a) and virus neutralization (PRNT). Vaccine formulation used in experiment 4743: purified inactivated SARS-CoV-2 produced from a research virus seed bank (rVSB) formulated in PBS with 17 µg $Al^{3+}$ (alum)/dose and 10 µg/dose CpG 1018.

Figure 4A:
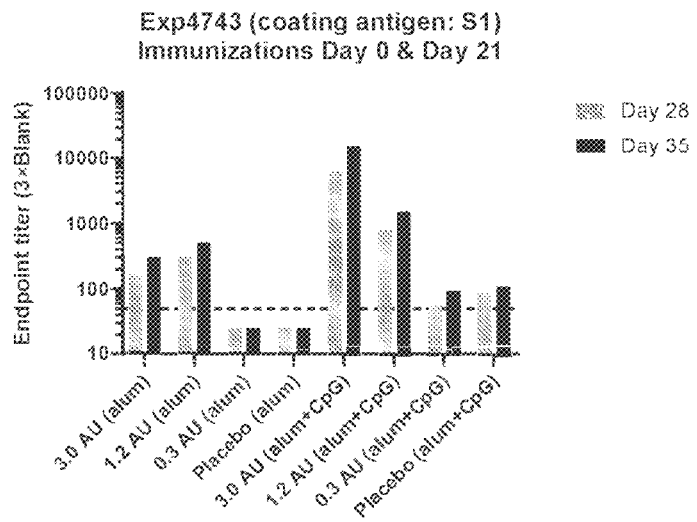
FIG. 4. Total IgG in response to SARS-CoV-2 vaccine. Coating antigens: S1 (A), receptor binding domain of spike protein (B) and nucleoprotein (C). Endpoint titer: absorbance of 3-fold the blank used as cut-off (dashed line).
Figure 4B:
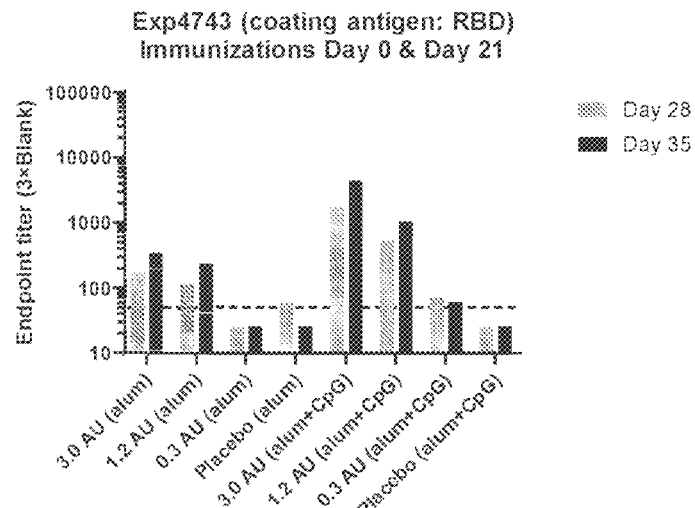
Figure 4C:
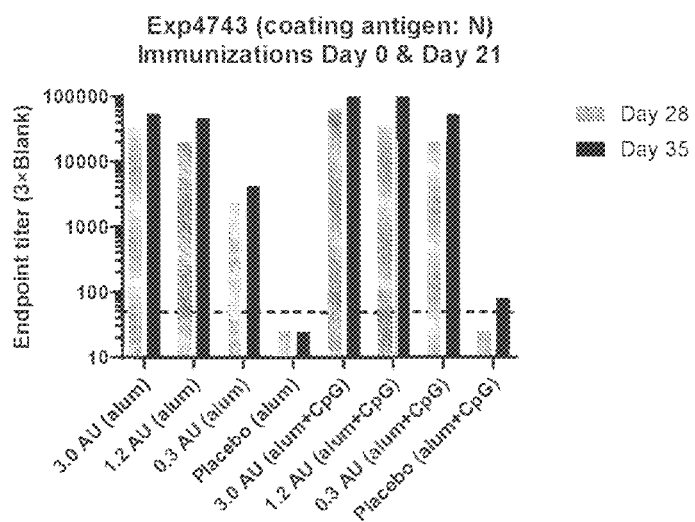

Antibody response to SARS-CoV-2 proteins The immune responses in mice for the different doses and adjuvant formulations were assessed with a total IgG ELISA (FIG. 4). Plates were coated with either the S1 part (FIG. 4A) or receptor binding domain (RBD) (FIG. 4B) of the spike glycoprotein or the nucleoprotein (FIG. 4C). Sera taken on days 28 and 35 were analyzed. Plates were coated with 2 µg/mL antigen (S1, RBD and N protein) and mouse sera were tested at a starting dilution of 1:50 in 4-fold dilutions. For detection a secondary monoclonal antibody (HRP-conjugated goat anti-mouse IgG) was used and developed with ABTS and read at absorbance 405 nm. Wells were washed with PBS-T between each step. Endpoint titers were determined with a cut-off set to 3-fold the blank.

Figure 5A:
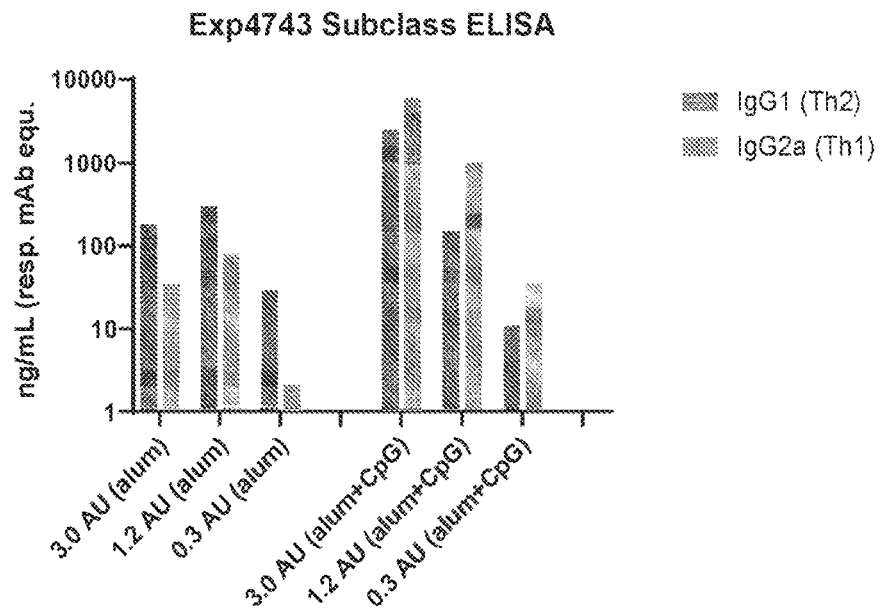
FIG. 5. IgG1 and IgG2a titers in response to SARS-CoV-2 vaccine adjuvanted with alum alone and alum/CpG 1018. Antibody titers specific to S1 protein were determined by ELISA. The concentrations were determined by comparison with a mAb subclass standard curve.

IgG subclass immune response Plates were coated with the S1 part (FIG. 4A) of spike glycoprotein and sera taken on day 35 were analyzed. Subclass specific secondary antibodies (IgG1 and IgG2a) conjugated with HRP were used for detection. As standard curves (4-parameter regression) for determination of the amount of the different IgG subclasses (IgG1 and IgG2a), monoclonal antibodies with different subclasses were used (IgG1 mAb clone 43 and IgG2a mAb clone CR3022). Bound HRP-conjugated secondary mAbs were developed with ABTS and read at absorbance 405 nm. Wells were washed with PBS-T between each step. The relative IgG subclass concentration is shown in FIG. 5A and the ratio of IgG2a/IgG1 in FIG. 5B.

Observations from Experiment 4743 Inactivated SARS-CoV-2 formulated with alum and CpG 1018 induced antibodies in mice against SARS-CoV-2 detected by ELISA measuring antibodies to S1 protein, receptor binding domain (RBD) and nucleocapsid protein (N) (FIG. 4A-C). An increase in immunogenicity was observed between bleeds on day 28 and day 35. A significant increase in immunogenicity, i.e., a dose-sparing effect, was seen for S1 and RBD in the presence of CpG 1018. In groups receiving the lowest doses (0.3 AU), a smaller increase not significantly above the placebo was seen for nucleoprotein, S1 and RBD ELISA titers.

Figure 5B:
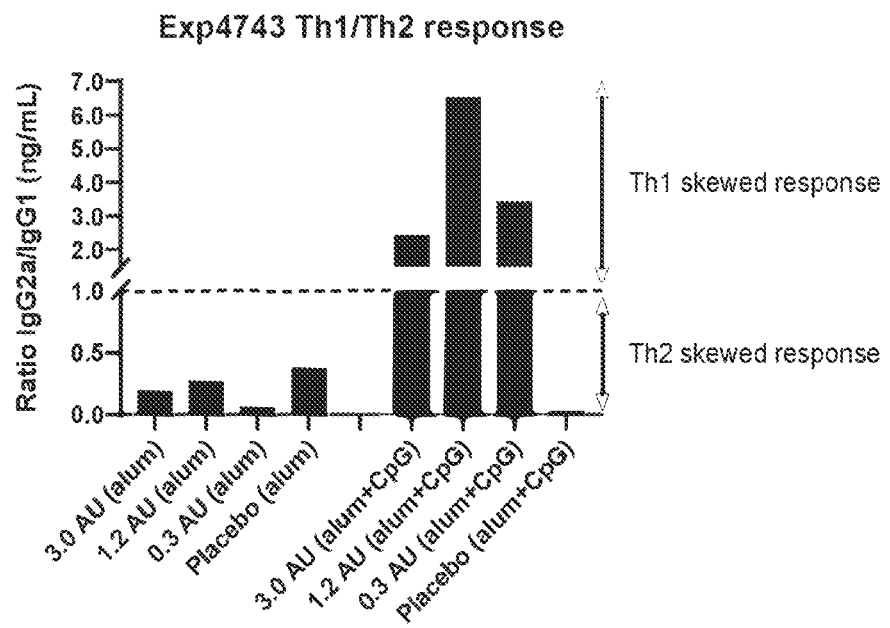

The addition of CpG 1018 to alum-adjuvanted inactivated SARS-CoV-2 promoted a substantial immune response shift towards Th1 (IgG2a) compared with Th2 (IgG1) as demonstrated by quantification of IgG subclasses by S1 ELISA. The amounts of IgG2a and IgG1 measured and the ratio of IgG2a:IgG1 in the treatment groups are shown in FIGS. 5A and 5B, respectively. A significant shift in the immune response toward Th1 (IgG2a) in the presence of CpG 1018 was observed. In the presence of CpG 1018 a stronger induction of IgG2a than IgG1 was observed. In the alum only groups a stronger induction of IgG1 than IgG2a is observed.

Figure 6:
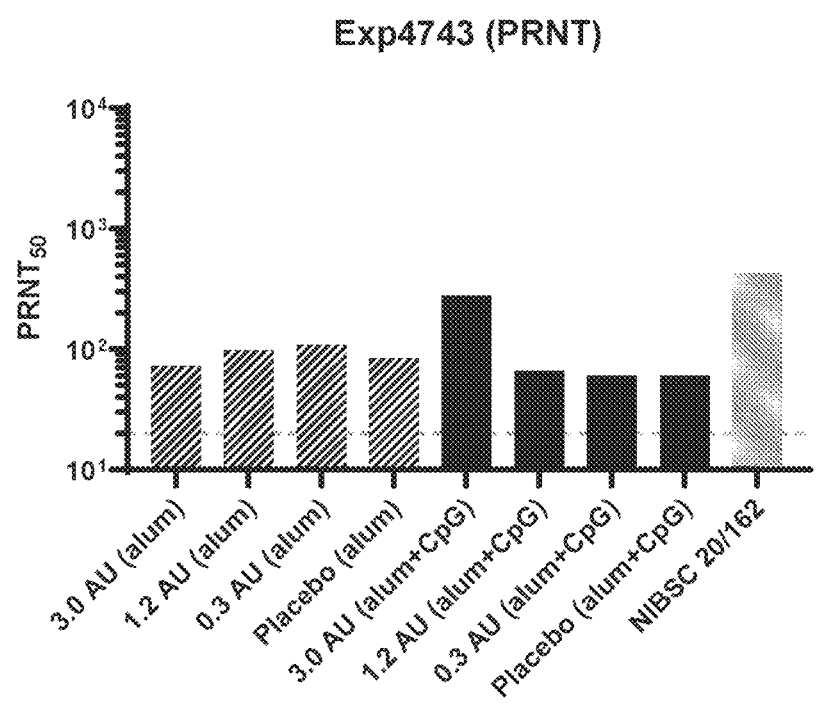
FIG. 6. Neutralizing titers in response to SARS-CoV-2 vaccine. The tested mouse sera were collected at d35. Neutralizing response in the presence of alum/CpG 1018 observed to be in the range of plasma from convalescent donors positive for SARS-CoV-2 (NIBSC 20/162; pooled sera from three donors).

Finally, the neutralizing response in the presence of alum/CpG in the group immunized with the highest SARS-CoV-2 dose was in the range of plasma from convalescent donors positive for SARS-CoV-2 (NIBSC 20/162; three pooled donors) (see FIG. 6).

Further immunization experiments are carried out in mice using GMP material with low doses (3, 1.2 and 0.3 AU) as a bridge between research and GMP material, as well as analyses of GMP material in mice with human doses (540, 10 and 3 AU).

Figure 9:
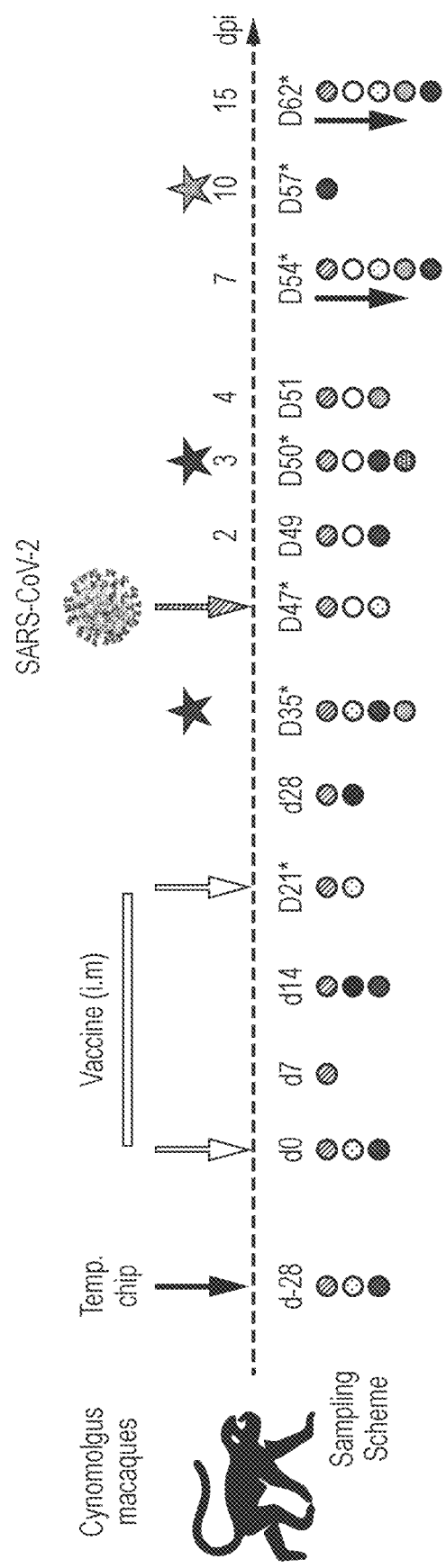
FIG. 9. Study design for NHP challenge study. Three groups of 8 animals each; Two dose groups for SARS-CoV-2 vaccine (10 AU & 40 AU, formulated with 0.5 mg/dose $Al^{3+}$ and 1 mg CpG 1018 per dose added directly before administration) and a placebo group (DPBS). The SARS-CoV-2 challenge strain is BetaCoV/France/IDF/0372/2020 (Maisonmasse et al., Hydroxychloroquine use against SARS-CoV-2 infection in non-human primates, 2020, Nature 585: 584-587). Methods and timing of testing: Hematology on d-28, d0, d7, d14, d21, d28, d35, d47, d49, d50, d51, d54, d62. Ab response (ELISA, IFA) on d-28, d0, d14, d21, d28, d35, d47, d54, d62. T cell response (ICS, ELISPOT) on d-28, d0, d14, d35, d54, d62. Cytokine response (LUMINEX) on d47, d49, d50, d51, d54, d62. SWABS (viral load (qRT-PCR-genomic+subgenomic): nasal & tracheal swabs on d35, d49, d50, d51, d54, d57, d62; rectal swabs at baseline and on d2, d7, d15. BAL viral load (qRT-PCR-genomic+subgenomic): d50. Euthanasia: lung harvest, viral load (qRT-PCR-genomic+subgenomic): d54, d62. CT scans: d35, d50, d57.

Additionally, a challenge study is carried out in immunized non-human primates (NHP) (see FIG. 9) and a passive transfer study is carried out in hamsters using sera from human subjects vaccinated with the SARS-CoV-2 vaccine candidate of the invention (see Table 1c).

TABLE 1c

Passive transfer study of the SARS-CoV-2 vaccine candidate of the invention in hamsters.

Study objective: Proof of concept that the SARS-CoV-2 vaccine candidate of the invention induces neutralizing antibodies providing protection against SARS-CoV-2 challenge in an animal model
Study design: Syrian hamsters receive sera from vaccinated subjects of the SARS-CoV-2 vaccine candidate of the invention Phase 1/2 study (see Example 4 below).
Hamsters are then challenged intranasally with SARS-CoV-2, Victoria/1/2020
A 10 day follow up includes:
Clinical observations and body weights recorded daily
Viral shedding/viral loads determined via RT-qPCR
Circulating antibodies prior to challenge (neutralization)
Tissues (lung and upper respiratory tract) taken at necropsy for determination of viral load and for histology Example 3. Testing of SARS-CoV-2 Vaccine for Antibody-Dependent Enhancement (ADE) of Disease and Immunopathology Although the mechanism is poorly understood, antibodies produced in response to a previous coronavirus infection or vaccination can increase the risk for 1) immunopathology and/or 2) antibody-dependent enhancement of disease during subsequent coronavirus infection. As such, any stimulation of antibodies to SARS-CoV-2 presents a hypothetical risk. In this regard, several approaches are undertaken to ensure safety of the current vaccine.

In vitro antibody-dependent enhancement assays Immune sera from inactivated SARS-CoV-2-vaccinated mice are assessed for hallmarks of enhanced disease in vitro. Such assays are described by e.g. Wang, S.-F., et al. 2014 (Antibody-dependent SARS coronavirus infection is mediated by antibodies against spike proteins (2014) BBRC 451:208-214). Briefly, susceptible cell types or cell lines are incubated with immune sera and subsequently infected with SARS-CoV-2. Cells are assessed for cytopathic effect and production of inflammatory markers.

Mouse model of immunopathology The risk of vaccine-enhanced immunopathology on challenge is assessed in a BALB/c mouse model as described by Tseng C. T. et al. (Immunization with SARS Coronavirus Vaccines Leads to Pulmonary Immunopathology on Challenge with the SARS Virus (2012) *PLoS ONE* 7(4):e35421). Briefly, the mice are immunized twice at two-week intervals with inactivated SARS-CoV-2 formulated as described herein followed by challenge with SARS-CoV-2. SARS-CoV-2 titers and immune cell infiltration of the lung are tested.

Non-human primate model of ADE The risk of ADE development in non-human primates is assessed as described by Luo F, et al. (Evaluation of Antibody-Dependent Enhancement of SARS-CoV Infection in Rhesus Macaques Immunized with an Inactivated SARS-CoV Vaccine (2018) *Virologica sinica* 33:201-204). Briefly, NHPs are immunized with inactivated SARS-CoV-2, followed by SARS-CoV-2 challenge and evaluation of symptoms and disease pathology.

Example 4. Clinical Phase 1 Study

Figure 10:
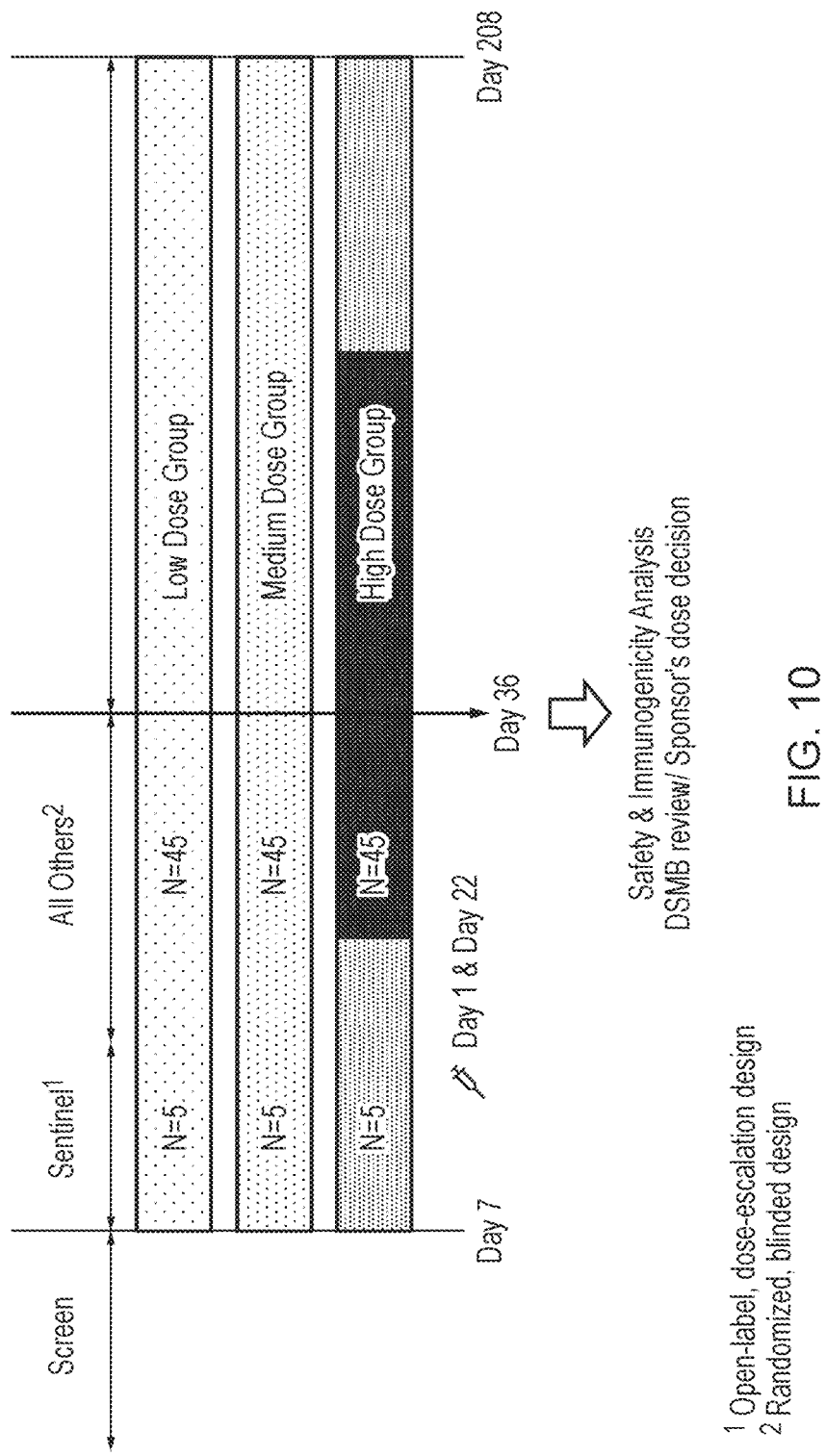
FIG. 10. Phase 1/2 clinical study: a blinded, randomized, dose-escalation study. Study Population: 150 healthy volunteers (50 subjects per dose group) aged 18 to 55 years. Dosage: two vaccinations (D1, D22; also referred to as D0, D21), low (~3 AU), medium (~10 AU) and high (~40 AU) dose. Immunization route: i.m.

Formulation of inactivated SARS-CoV-2 for Phase 1 trial The objective of the Phase 1 trial is to assess the safety of the vaccine, along with immunogenicity, and to determine an optimal dose and adjuvant in healthy human subjects. As such, three antigen doses were tested in clinical phase 1:

High, Medium and Low, which are chosen to have a distance between each dose of approximately 3-fold and a span covering about a 10-fold difference between the high and low doses (e.g., 0.5, 2 and 5 µg/dose or 3, 10 and 40 AU/dose). About 150 healthy volunteers were enrolled (153), 50 subjects per dose group aged 18 to 55 (see FIG. 10). The dose range is selected in part to indicate any potential dose-sparing effect of CpG. As previously reported in the literature, a 2-3 fold reduction in required antigen may be expected in the presence of CpG. The three dosages are tested without antigen and with 1 mg CpG plus 0.5 mg alum ($Al^{3+}$). Currently $1^{st}$ vaccination completed, $2^{nd}$ vaccination ongoing. Two DSMB meetings have been performed with first meeting following availability of initial safety data from sentinel subjects (N=15), there no safety concerns identified, thus blinded randomized study phase initiated. $2^{nd}$ DSMB for interim safety review upon completion of first vaccinations (N=153), there no safety concerns identified. First data readout (day 36 safety and immunogenicity) expected by April 2021 as basis for dose decision for phase 3 (see Example 5).

Figure 8:
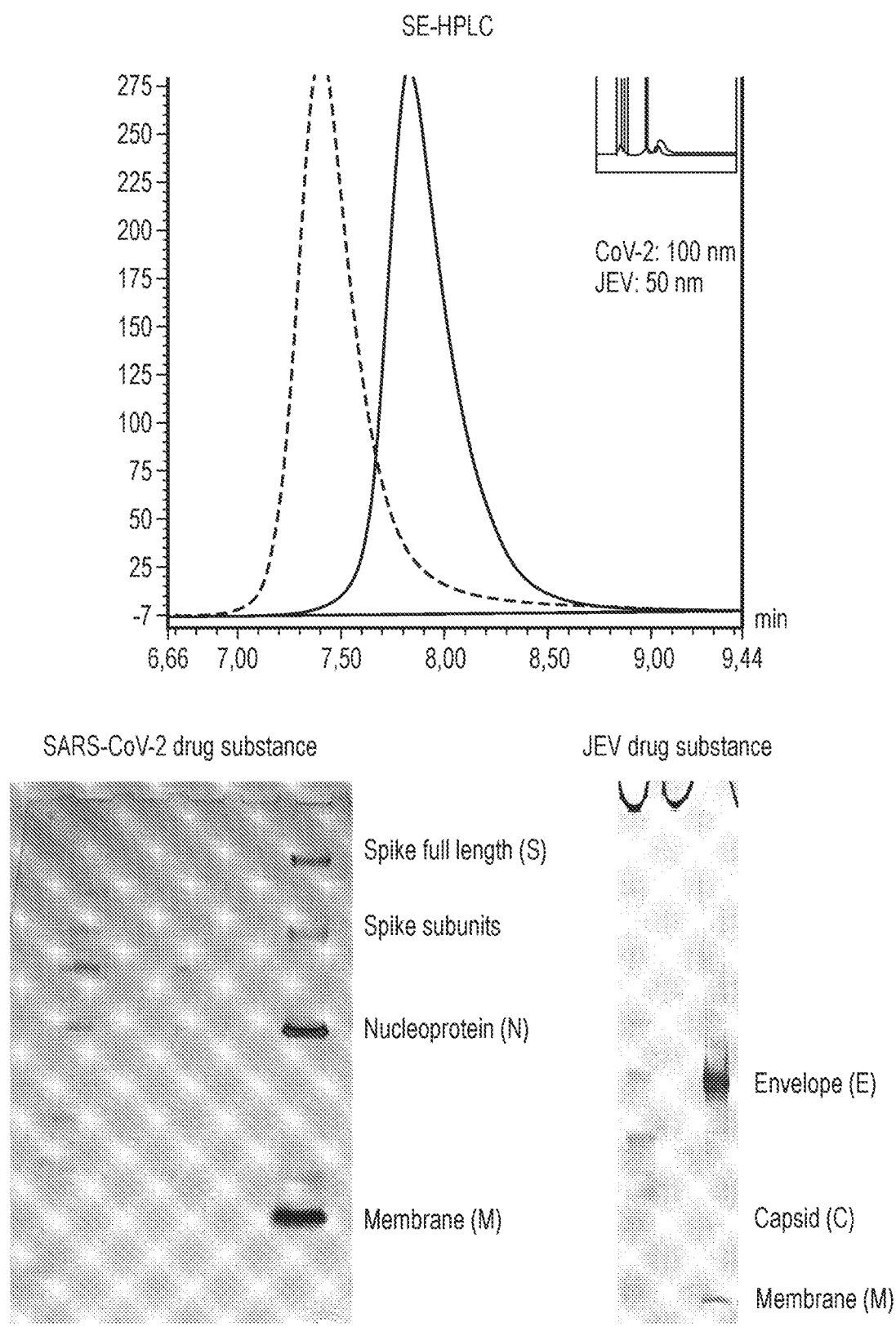
FIG. 8. Comparison of Size-Exclusion-Chromatography and SDS-PAGE profiles of SARS-CoV-2 and JEV drug substance. High purity (>95%) according to SDS-PAGE (silver stain, reduced) and monomer virus (>95%) according to SE-HPLC. Difference in retention time due to different virus particle size (JEV (IXIARO) about 50 nm, SARS-CoV2 about 100 nm).

The SARS-CoV-2 virus as purified herein has a high purity of >90% as assessed by SDS-PAGE, SE-HPLC and/or SARS-CoV-2 ELISA (FIG. 8). Furthermore, preliminary studies have indicated that the incidence of genetic heterogeneities during passage of the virus is low and no particular individual mutations stand out (data not shown).

To arrive at a dose range, the SARS-CoV-2 virus was compared with JEV, specifically assessing SE-HPLC peak area per dose equivalent (recorded as milli-absorption units× minutes; mAU), the total amount of inactivated viral particles per dose and the total viral surface equivalent per dose (see Table 4). This assessment was based on the assumption of a similar surface antigen density between S (spike; SARS-CoV-2) and E (envelope; JEV) proteins. Total protein was determined by µBCA assay (Table 4). Although the assay was variable, a correspondence of 1 mAU to ~2 µg total protein per mL was observed. Another determination using an optimized SARS-CoV-2 S-protein ELISA, as outlined in Example 1, was also performed.

TABLE 4

Comparison of JEV and SARS-CoV-2 quantification parameters and an approximation of the total protein in Low, Medium and High SARS-CoV-2 dosage groups for Phase 1 clinical trials.

| Dose | SE-HPLC peak area equivalent CoV/JEV | Ratio total particle equivalent CoV/JEV | Ratio surface antigen equivalent CoV/JEV | Estimated total protein/dose in µg (µBCA assay) |
|---|---|---|---|---|
| Low | 0.25 | 0.015 | 0.070 | 0.5 |
| Medium | 1 | 0.058 | 0.288 | 2 |
| High | 2.5 | 0.145 | 0.719 | 5 |

As SARS-CoV-2 virus particles (~92 nm diameter) are much larger than Flavivirus particles (~40 nm), corresponding to an approximately 5-fold greater virus surface area per particle, an equivalently higher antigen content is expected. Furthermore, other inactivated virus vaccine preparations, including JEV (IXIARO®), TBE (ENCEPUR®) and HepA (VAQTA®) reported antigen dose in the low µg to ng protein range. As these viruses are all formalin inactivated, the BPL-inactivated SARS-CoV-2 virus of the current invention has better preserved surface antigen proteins, i.e., a better quality antigen, and requires a lower total protein dose.

For entry into the clinic a further antigen determination assay (SARS-CoV-2 ELISA assay as described in Example 1) was developed and the doses of the vaccine formulations for entry into Phase 1 trials were determined using this assay. The Phase 1 treatment groups are set forth in Table 5.

Formulation of SARS-CoV-2 vaccine for phase 1 trial (0.5 mL/dose):
  Antigen (inactivated SARS-CoV-2) target doses (one dose=0.5 mL):
  Low: about 3 AU/0.5 mL*
  Medium: about 10 AU/0.5 mL)*
  High: about 40 AU/0.5 mL*
  *doses determined by the SARS-CoV-2 ELISA assay as described in Example 1
  Aluminium hydroxide ($Al^{3+}$): 0.5 mg/dose (1 mg/mL)
  CpG 1018: 1 mg/dose (2 mg/mL)
  Recombinant Human Serum Albumin (rHSA): ~25 µg/dose (~50 µg/mL)
  Buffer: Phosphate buffered saline (PBS)

In some cases, vaccinated subjects are challenged with an infectious dose of live SARS-CoV-2 virus (Asian and/or European lineage).

TABLE 5

Treatment groups for Phase 1 testing of inactivated SARS-CoV-2 vaccine (low, medium and high doses as set forth above). Two doses are administered (day 0 and day 21).

| Group | Antigen | Aluminium hydroxide | CpG 1018 |
|---|---|---|---|
| 1 | Low | − | − |
| 2 | Med | − | − |
| 3 | High | − | − |
| 4 | Low | + | + |
| 5 | Med | + | + |
| 6 | High | + | + |

Example 5. Clinical Phase 3 Study

Figure 11:
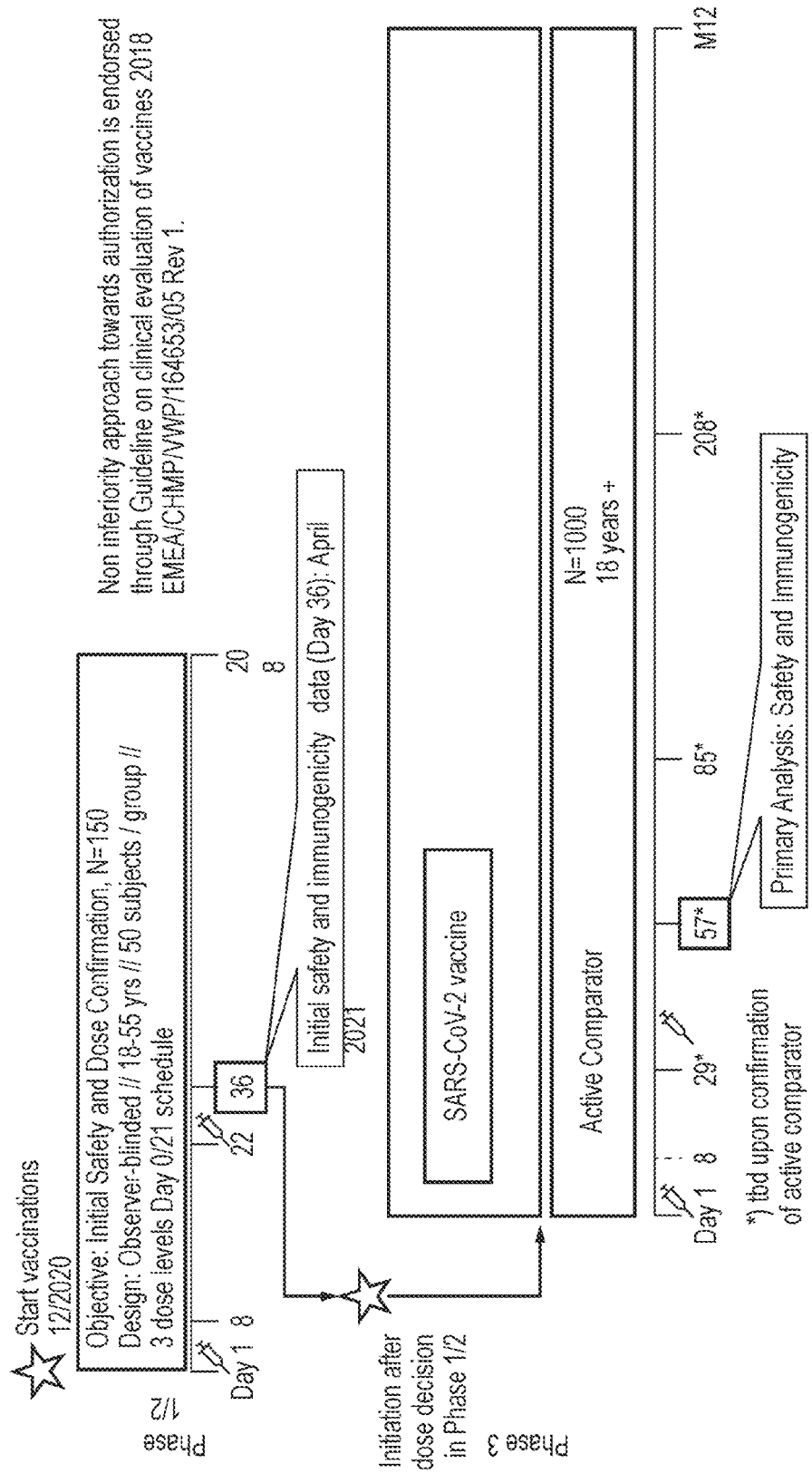
FIG. 11. Study design for a non-inferiority pivotal phase 3 immunogenicity trial for initial licensure. Vaccine efficacy determined by demonstrating non-inferior neutralizing antibody titers between SARS-CoV-2 vaccine of the invention and a licensed COVID-19 vaccine for which efficacy has been established.

Neutralizing Antibodies are Emerging as a Robust Clinical Parameter:
  Emerging clinical evidence suggesting neutralizing antibodies are associated with protection against COVID-19
  Protection from moderate to severe COVID-19 disease has been shown to coincide with emergence of neutralizing antibody levels against SARS-CoV-2 (field efficacy study with the mRNA vaccine of Pfizer/Biontech)
  Monoclonal antibody (Bamlanivimab) was shown to prevent subjects from developing symptomatic COVID-19 by 80% in a phase 3 trial conducted by the National Institutes of Health's National Institute of Allergy and Infectious Diseases (NIAID),
  Monoclonal antibody administration in hamsters or non-human primates have been shown to protect from disease induced by COVID-19 in these animal models.
  Adoptive transfer of purified IgG from convalescent rhesus macaques (*Macaca mulatta*) has been shown to protect naive recipient macaques against challenge with SARS-CoV-2 in a dose-dependent fashion
  Plan for Phase 3 Non-Inferiority Study (FIG. 11)
  Randomized, observer-blind, controlled, non-inferiority study to compare the immunogenicity of inactivated SARS-CoV-2 vaccine of the invention*** to [Active Comparator, e.g. AZD1222 or BNT162b2, to be determined]

Dosage: two i.m. vaccinations within 1 month; Dose level selected based on Phase 1/2

Study Population: 4000* healthy volunteers aged 18 years and above, randomized 3:1 to receive inactivated SARS-CoV-2 vaccine of the invention or [Active Comparator] to establish safety database for initial licensure Immunogenicity sub-set of approximately 600 participants** who have tested sero-negative for SARS-CoV-2 at screening; 1:1 distributed to inactivated SARS-CoV-2 vaccine of the invention or [Active Comparator]

Primary Endpoint:
  Non-inferiority of immune response 4 weeks after completion of a 2-dose Immunization Schedule, as determined by the GMT of SARS-CoV-2-specific neutralizing antibodies or seroconversion rate

Figure 12:
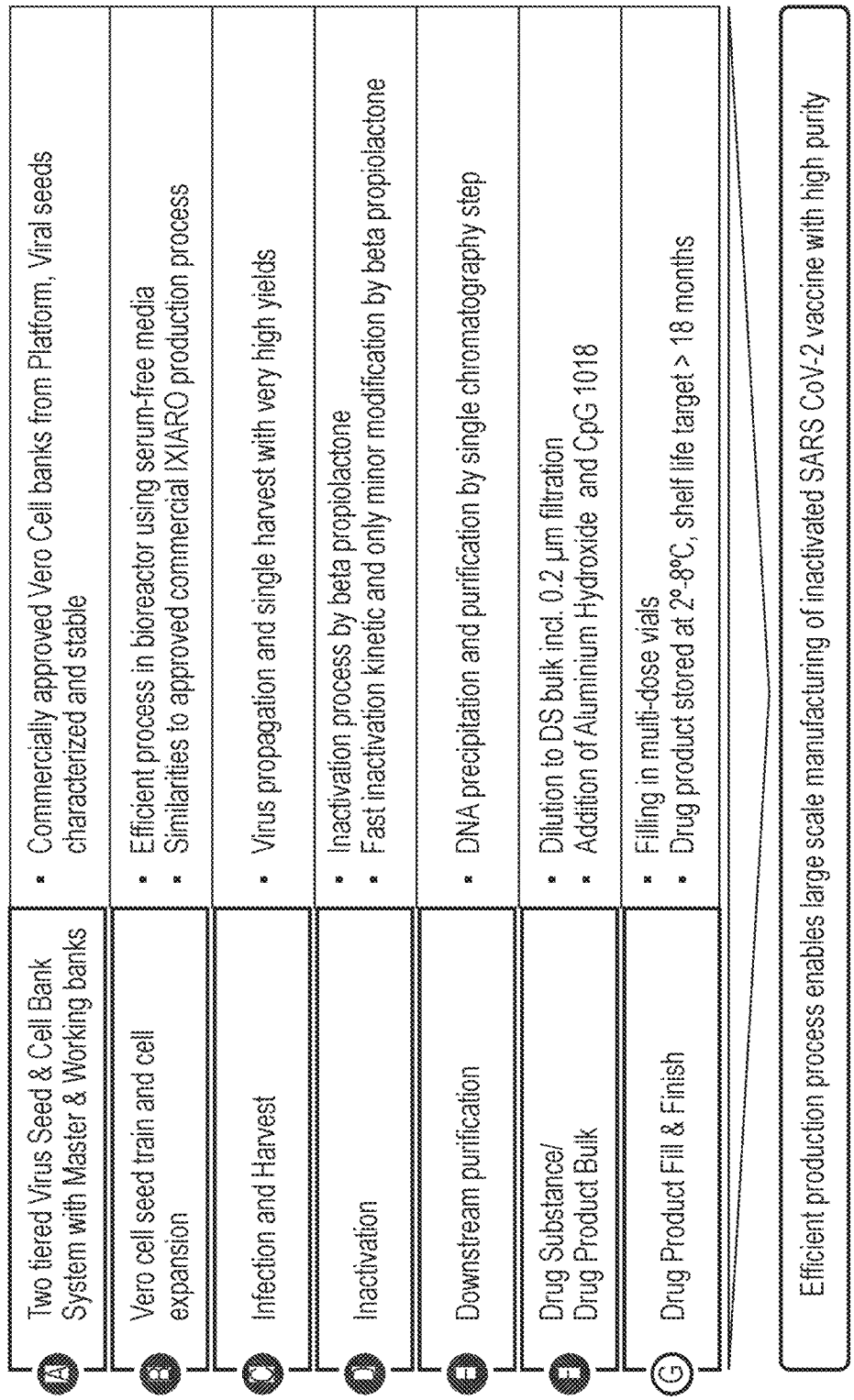
FIG. 12. Outline of the final SARS-CoV-2 manufacturing process—the fully industrialized production process.

* A sample size of 3000 subjects vaccinated with the inactivated SARS-CoV-2 vaccine of the invention will allow for the detection of at least 1 rare event (incidence rate 1/1000) with a probability of 94% in this study.
** Sample size to be confirmed upon availability of phase 1/2 immunogenicity results
***See FIG. 12. Phase clinical trial material comparable to clinical study material of phase 1 (see Example 1)

Example 6. Testing of Sera of Vaccinated Organism with a Neutralization Assay Sera of vaccinated mice, hamsters, non-human primates or humans can be tested in neutralization assays such as e.g. described in "Szurgot, I., Hanke, L., Sheward, D. J. et al. DNA-launched RNA replicon vaccines induce potent anti-SARS-CoV-2 immune responses in mice. Sci Rep 11, 3125 (2021). doi.org/10.1038/541598-021-82498-5".

The read out of the test gives an indication how well sera of vaccinated subjects can neutralize new variants and thus guides in the design of the vaccine.

Example 7. Liquid Chromatography with Tandem Mass Spectrometry (LC-MSMS) Analysis of Inactivated SARS-CoV-2

Methodology:

Two samples of the BPL-inactivated SARS-CoV-2 particles were separated using SDS-polyacrylamide gel electrophoresis and the bands were visualized by silver staining. The bands were cut and subjected to in-gel digestion with trypsin and the resulting peptides analysed with nano-liquid chromatography coupled to a high-resolution accurate mass spectrometer. Peptides were identified from raw spectra using the MaxQuant software package and the UniProt reference databases for SARS-CoV-2 and *Chlorocebus sabaeus*. To account for modifications the data were re-searched specifically for B-propiolactone modifications, and the obtained results were confirmed with a second independent search algorithm (Sequest in Proteome Discoverer suite). Additionally, data were searched with the FragPipe package to account for further unknown MS-detectable modifications.

Results:

Protein Identification:

The bands could be clearly attributed to the three main viral proteins (Spike-protein, Membrane-protein, Nucleoprotein) as well as to background proteins from the host system (see FIG. 10).

Traces of SARS-CoV-2 ORF9b and the replicase polyprotein could also be detected, but these proteins were probably not well resolved on the gel due to their size. The separation pattern on the gel was very similar for both samples with the exception of a host protein band (band 2.3), a slightly different S-protein pattern (bands 2.10-2.13), and an expected strong band of serum albumin in one of the samples (sample 2). Additionally, a number of typical lab contaminants of human origin (e.g. keratins) were detected in the background of both samples. The processing of the Spike-protein (from full length to S1, S2, and S2') is difficult to resolve with the applied methodology but is most likely represented by the pattern in bands 9-13 in both samples.

Modification Analysis:

Based on a publication by Uittenbogaard et al. (Reactions of β-Propiolactone with Nucleobase Analogues, Nucleosides, and Peptides, Protein Structure and Folding| Volume 286, ISSUE 42, P36198-36214, Oct. 21, 2011), it was expected to find ß-propiolactone (BPL) modifications on cysteine, methionine, and histidine. Uittenbogaard et al. studied amino acids which are subject to modification by beta-propiolactone, along with the type of modification, e.g., acylation, alkylation. They have shown that BPL can react with up to 9 different amino acids (C,H,M,D,E,Y,K,E,S) depending on actual pH. In their studies higher conversions within the relevant pH range 7 to 9 were observed for Cysteine (>95%), Histidine (15-25%) and Methionine (36%) residues. The conversion rates for Aspartic Acid, Glutamic acid and Tyrosine were much lower in the range of approximately 3-15%. It was shown that disulfide groups in Cystine residues do not react.

In BPL-inactivated SARS-CoV-2 particles, BPL modifications could be detected (mainly in the form of +72 Da) but at a low abundance. Out of 2894 (sample 1) and 3086 (sample 2) identified spectra for SARS-CoV-2 proteins only 73 and 110, respectively, carried a BPL modification, which translates to 2.5 to 3.65% (see Table 6). This was also confirmed by the open modification search using FragPipe, which attributed a similarly low fraction of spectra to mass differences matching the BPL-modification.

TABLE 6

Number of identified SARS-CoV-2 peptide spectra

| Sample | Total spectra | BPL spectra | % modified |
|---|---|---|---|
| Sample 1 | 2894 | 73 | 2.5% |
| Sample 2 | 3086 | 110 | 3.6% |

Spectra of all BPL-modified peptides reported for SARS-CoV-2 proteins were inspected manually of which 6 to 8 sites were confirmed for sample 1 and 2, respectively (see Table 6). For all of these validated sites also the unmodified peptides were identified suggesting that the modification with BPL never reached 100%. We estimated the degree of modification on a particular site (the so-called site occupancy) as the ratio of modified to unmodified peptide for the same modification site normalized to the protein abundance for each band. We then selected the maximum occupancy for each site as a conservative measure of the degree of site modification. As shown in Table 7 the occupancy was in general rather low for the sites identified, in agreement with the total number of identified spectra. The only exception, M234 of the nucleoprotein, has to be interpreted carefully, as that particular peptide sequence has problematic features which likely make the estimation for this particular peptide less accurate and reliable as compared to the other sites.

TABLE 7

BPL-modified sites identified and their occupancy

| Protein | Site Position | % occupancy sample 1 | % occupancy sample 2 |
|---|---|---|---|
| Spike-protein | H207 | <0.1% | 16% |
| Spike-protein | H245 | 1% | 3% |
| Spike-protein | C379 | <0.1% | n.d. |
| Spike-protein | M1029 | <0.1% | <0.1% |
| Spike-Protein | C1032 | <0.1% | n.d. |
| Membrane protein | H154 | <0.1% | <0.1% |
| Membrane protein | H155 | 1% | 1% |
| Membrane protein | C159 | n.d. | <0.1% |
| Membrane protein | H210 | 5% | 6% |
| Nucleoprotein | M234 | <0.1% | 88%* | n.q. = not quantified;
n.d. = not detected
*quantification uncertain, due to missed cleavages and oxidation Apart from the expected modifications the FragPipe search revealed two other modifications (most likely acetaldehyde and acetylation) to occur in around 10% of the spectra. These modifications represent most likely artifacts introduced during gel staining and sample preparation, as they also occur on contaminant proteins.

Summary

Based on the results described above it is concluded that the main components in these samples corresponds to SARS-CoV2 proteins. The BPL modifications were detectable but appeared to be low, i.e. around 3% on whole SARS-CoV-2 proteome level (i.e. all SARS-CoV-2 proteins identified). Only 5 amino acids of the S-protein were found to be modified and this was also only detected for a minority of the analysed S-protein (e.g. around 16% for the Spike-protein at the H207 amino acids, i.e. the probability to have a modification at H207 was around 16%). The two samples differ only slightly with respect to some background proteins and in their degree of modification, with sample 1 showing slightly lower levels of BPL-modification. Please note that only about 30 to 40% of the amino acids of the Spike protein could be tested.

Conclusion:

This data supports the view that the mild inactivation approach of the invention minimizes the modifications within the S-protein and thus the native surface of the S-protein is largely preserved. In comparison, determination of modifications by BPL inactivation of flu samples were more frequent, i.e. 83 sites on HA and 43 sites on NA for one sample flu vaccine (NIBRG-121xp) and 99 sites on HA and 39 sites on NA for another sample (NYMC-X181A) were modified, wherein HA and NA are the two major membrane glycoproteins, i.e. the primary immunogens for flu (She Yi-Min et al., Surface modifications of influenza proteins upon virus inactivation by beta-propiolactone; *Proteomics* 2013, 13, 3537-3547, DOI 10.1002/pmic.201300096). Thus BPL inactivation of influenza virus can lead to numerous protein modifications including some affecting membrane fusion.

Example 8. Immunogenicity, Neutralizing Antibody Responses and Protective Effect in Non-Human Primates In this study, non-human primates (cynomolgus macaques) were immunized with either a medium dose or high dose of an inactivated SARS-CoV-2-vaccine as described above (see e.g. Example 4). Immunogenicity, neutralizing antibody responses and protective effect were then determined (see e.g. Examples 2 and 6).

Total IgG Immune Responses in Cynomolgus Macaques

The immune responses in cynomolgus macaques for the two doses (medium and high) were assessed with a total IgG ELISA. Plates were coated with either the soluble ectodomain of spike protein with a T4 trimerization domain (A) or receptor binding domain (RBD) (B) of the spike glycoprotein or the nucleoprotein (C). Sera taken at baseline (day −1) and on days 0, 14, 21 28, 35 and 47/49 were analyzed. Antibody units (AU) were determined by fitting the relative luminescence to the respective standard curves with a known IgG concentration in AU/mL.

The results are shown in FIG. 16. The inactivated SARS-CoV-2-vaccine was highly immunogenic in cynomolgus macaques, and a plateau in the immune response was already reached one week after the second immunization. There was no significant difference in the immune responses between high and medium dose.

Neutralizing Antibody Responses in Cynomolgus Macaques

Presence of functional antibodies in macaque immune sera after immunization with the inactivated SARS-CoV-2-vaccine was assessed in a serum neutralization test. Serial dilutions of sera (days 0, 14, 21, 28, 35 and 47/49) were incubated with SARS-CoV-2 (SARS-CoV-2 strain Slovakia/SK-BMCS/2020), where spike glycoprotein specific antibodies bind to the virus, thereby blocking virus attachment to the ACE2 receptor on the surface of the target cells, and prevent entry into the cell. The 50% endpoint titers ($SNT_{50}$) were determined with the Spearman-Kärber method.

The results are shown in FIG. 17. As for the total IgG titers, a plateau was reached for both medium and high doses one week (day 28) after the second immunization. There seems to be a difference between the high and the medium doses on days 28 and 35, however, this difference is not statistically significant.

Viral Colonization in Cynomolgus Macaques

Four weeks after the second immunization, macaques were challenged intranasally (0.25 mL per nostril) and intratracheally (4.5 mL) with $1\times10^5$ PFU SARS-CoV-2 (SARS-CoV-2 strain BetaCoV/France/IDF/0372/2020 SARS-CoV-2). Nasopharyngeal and tracheal swabs were taken before challenge (day 35) and on days 1, 2, 3, 4, 7 11 and 15 days post infection. Bronchoalveolar lavage (BAL) was collected on day 3 post infection. Swabs and BAL were analyzed with RT-qPCR (genomic and subgenomic) for presence of SARS-CoV-2.

The results are shown in FIGS. 18 to 20. Cynomolgus macaques immunized with the inactivated SARS-CoV-2-vaccine were protected from a combined intranasal and tracheal challenge with SARS-CoV-2. SARS-CoV-2 genomic RNA could transiently be detected in immunized macaques on day 2 post infection at a very low level in nasopharyngeal and tracheal swabs, but not at all in BAL. Sub-genomic SARS-CoV-2 RNA was not detectable at all in nasopharyngeal and tracheal swabs, nor in BAL. Sub-genomic RNA is a measure of virus which has replicated in the host. No difference between the high and medium dose of the inactivated SARS-CoV-2-vaccine could be detected in regard to the level of protection observed.

Example 9. Immunogenicity of Inactivated SARS-CoV-2 Vaccine in Rats

This study relates to a prophylactic, purified, inactivated SARS-CoV-2 vaccine for the prevention of COVID-19 caused by SARS-CoV-2. SARS-CoV-2 is propagated on Vero cells and inactivated by β-propiolactone. In this example, a repeat dose and local tolerance toxicity study was performed in female and male rats to assess potential systemic toxicity and local tolerability of the inactivated SARS-CoV-2 vaccine.

A human dose of 53 antigen units (AU)/0.5 mL was formulated with an aluminium salt (ALHYDROGEL®) and CpG 1018. Rats were given intramuscular injections (2 sites×0.2 mL, 42 AU) on three occasions with 2 weeks interval over a period of 29 days. Blood was collected by venipuncture from the jugular (or other suitable) vein on day 8, day 15 and day 22 as well as on day 51.

Serum samples from the animals assigned to the recovery phase of the study were analyzed to assess the immunogenicity of the vaccine and monitor the immune response over time.

Material and Methods
Equipment
Multiplate washer BIOTEK® ELx405 Select CW with Bio-Stack.
Multiplate reader BIOTEK® Synergy 2 using Microplate software Gen5 (version 3.10.06) for data acquisition and evaluation.
GraphPad Prism (version 8.4.3) was used for plotting and visualization of data.

Material and Reagents
Nunc MAXISORP™ flat-bottom 96 well microtiter plates (Thermo Scientific, #439454) Microplate, 96 well, PS, F-bottom, clear (Greiner Bio-One International, #655161)
Dulbecco's Phosphate Buffered Saline (DPBS) 1× (Gibco, #14190-094) Dulbecco's Phosphate Buffered Saline (DPBS) 10× (Gibco, #14200-067)
Bovine Serum Albumin (BSA) Fraction V (biomol, #01400.100)
Tween 20 (Sigma-Aldrich, #P7949-500 ml)
Goat Anti-Rat IgG-HRP (Southern Biotech, #3030-05)
ABTS [2,2' Azino-bis(3-ethylbenzothiazoline-6-sulfonic acid)] (Sigma-Aldrich, #A3219-100 ml)
Sodium dodecyl sulfate (SDS) (Sigma-Aldrich, #71729)
Spike S1 protein, 78 kDa (Aviva, #OPAN06665-100UG)
Biological Material
Rat serum samples were collected on study days 8, 15, 22 and 51 from the two groups in the recovery study (Table 8), frozen at the test facility, shipped on dry-ice and stored at −80° C. until analysis.

TABLE 8

Experimental design, recovery groups.

| Treatment | Dosage Level (AU/dose) | Dose Volume (mL)* | Number of Animals | |
|---|---|---|---|---|
| | | | Males | Females |
| 0.9% sodium chloride | 0 | 0.4 | 5 | 5 |
| Vaccine | 42 | 0.4 | 5 | 5 |

*One injection to each hind limb (2 × 0.2 mL) on each dosing occasion

Methods
ELISA
Vaccine-specific serum antibody responses were determined using the ELISA protocol as described below.
ELISA plates (MAXISORP™, Nunc) were coated with 100 ng spike S1 protein in PBS and incubated at 4° C. overnight. The plates were blocked with 5% BSA, 0.05% Tween-20, PBS for 1-2 hours at RT. Plates were washed with PBS/0.1 T (PBS with 0.1% Tween-20). Individual rat sera (five per plate) were diluted in blocking buffer (five-fold dilution), added to 96-well plates and tested in duplicates by incubating for 1 hour at RT. Plates were then washed with PBS/0.1 T. The secondary antibody (Goat Anti-Rat IgG-HRP, Southern Biotech) was diluted 1:4,000 in blocking buffer, added to the 96-well plates and incubated for 1 hour at RT. Plates were washed with PBS/0.1 T and ABTS (Sigma-Aldrich) was added as substrate. After incubation for 30 min, the reaction was stopped by the addition of 1% SDS and the absorbance was read at 405 nm. The half-max titer (the reciprocal of the dilution that corresponds to the mean absorbance between highest and lowest dilution) was determined.

Sample Fate
After completion of the analysis and acceptance of the results, the remaining samples were discarded.

Results
Serum samples obtained from two study groups at different time points were analyzed by ELISA. The geometric mean titers for male and female rats from each group, time point are shown in the Table 9 below.

TABLE 9

Geometric mean half-max titers for each group split into male and female rats

| Group | Sex | Study Day | | | |
|---|---|---|---|---|---|
| | | 8 | 15 | 22 | 51 |
| 0.9% sodium chloride | Male | <50 | <50 | <50 | <50 |
| | Female | <50 | <50 | <50 | <50 |
| Vaccine | Male | <50 | 253 | 6983 | 11431 |
| | Female | <50 | 127 | 19680 | 12279 |

Sera from rats in the placebo group (0.9% sodium chloride) showed no reactivity (half-max titer <50) at any of the time points when analyzed by ELISA (see Table 9 above).

Figure 21:
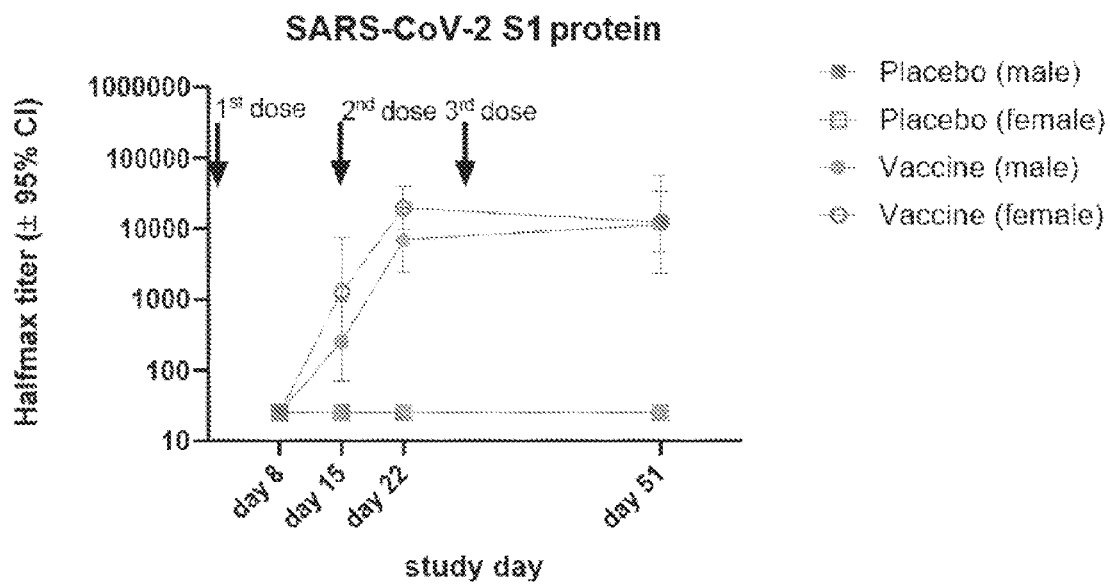
FIG. 21: Graphical presentation of GMTs for male and female rats for each treatment group. Placebo is square symbols (male: filled symbols, female: unfilled symbols) and inactivated SARS-CoV-2 vaccine is circular symbols (male: filled symbols, female: unfilled symbols) over the course of the study. Error bars indicate 95% confidence intervals (CI). GMT <50 were imputed to 25.
Figure 22:
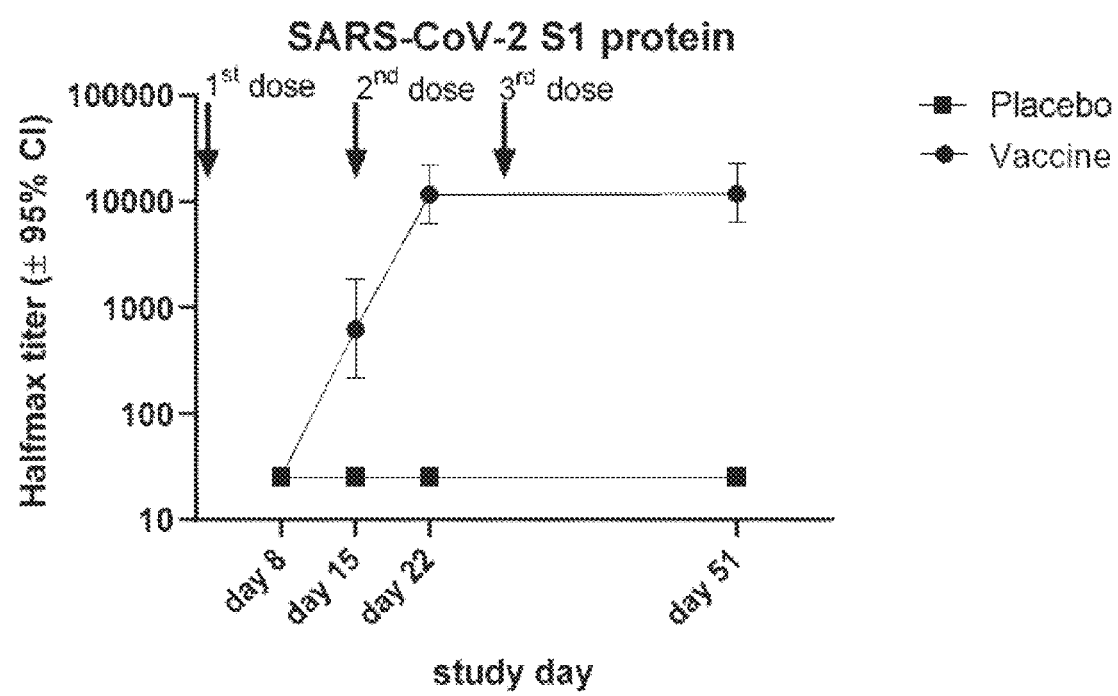
FIG. 22: Graphical presentation of GMTs for each treatment group, data for male and female rats combined. Placebo is square symbols and inactivated SARS-CoV-2 vaccine is circular sym. Error bars indicate 95% confidence intervals (CI). GMT <50 were imputed to 25.

Rats in the group vaccinated with inactivated SARS-CoV-2 vaccine showed after the first immunization a weak response, however, below a measurable half-max titer (data not shown). One week after the second immunization (day 22) a plateau in the immune response was reached (see Table 9 above, FIG. 21 and FIG. 22). A slightly higher immune response was observed in female rats on study days 15 and 22 (see Table 9 above, FIG. 21). However, this difference was not statistically significant.

Discussion
In this study, the inactivated SARS-CoV-2 vaccine was shown to be highly immunogenic in all rats. However, a low immune response was observed following a single immunization. Subsequent immunization resulted in continued increases in anti-spike S1 protein antibody titers. A plateau was reached after the second immunization, suggesting that a two-dose regime could be sufficient to reach high antibody titers at least in rats. The third immunization did not further increase the antibody titers. A normal dose kinetics was seen in the animals.

Conclusion
The analysis described in this report indicated that the inactivated SARS-CoV-2 vaccine was highly immunogenic in rats and induced robust antibody titers in rats.

Example 10. Further Liquid Chromatography with Tandem Mass Spectrometry (LC-MSMS) Analysis of Inactivated SARS-CoV-2

Methodology:

A further LC-MSMS analysis of BPL-inactivated SARS-CoV-2 particles, as described in Example 7, was performed in order to obtain greater coverage of the proteins. Five aliquots of the BPL-inactivated SARS-CoV-2 sample were separated on SDS-PAGE and the bands visualized by either silver staining for visualization or Coomassie staining for processing. The Coomassie-stained bands corresponding to spike protein (based on previous analysis) were subjected to in-gel digestion with trypsin or chymotrypsin or to acid hydrolysis. Trypsin digests were performed twice, once with and once without previous PNGase F (peptide:N-glycosidase F) digestion, to identify peptides masked by glycosylation.

Digested peptides were analysed by LC-MSMS essentially as described in Example 7. In particular, the resulting peptides were analyzed with nano-liquid chromatography coupled to a high-resolution accurate mass spectrometer. Peptides were identified from raw spectra using the MaxQuant software package and the UniProt reference databases for SARS-CoV-2 and *Chlorocebus sabaeus* in combination with a database of common lab contaminants. To account for modifications the data were also searched specifically for ß-propiolactone (BPL) modifications, and spectra of all BPL-modified peptides of the SARS-CoV-2 spike protein were manually validated. The degree of modification was globally estimated as the percentage of BPL-modified spectra identified, and on site-level by calculating site occupancies from the ratio of modified to unmodified peptides for each peptide/site separately.

Results:

The total coverage of particular SARS-CoV-2 proteins, using the combination of four digestion methods (i.e. (i) trypsin (ii) trypsin+PNGase F (iii) chymotrypsin and (iv) acid hydrolysis) was as follows:

Spike (S) protein—91.5%
Membrane (M) protein—60.36%
Nucleoprotein (N)—74.70%

The number of BPL-modified peptides in the inactivated SARS-CoV-2 particles, based on each digestion method, is shown in Table 10 below:

TABLE 10

Number of identified SARS-CoV-2 peptide spectra across all bands analyzed

| Sample | Total | BPL modified | % BPL modified |
|---|---|---|---|
| Trypsin | 3148 | 97 | 3.1% |
| Trypsin + PNGase F | 2354 | 61 | 2.6% |
| Chymotrypsin | 2753 | 174 | 6.3% |
| Acid hydrolysis | 939 | 33 | 3.5% |
| Total | 9194 | 365 | 4.0% |

As shown in Example 7, this confirms that the percentage of BPL-modified peptides is low regardless of the digestion method, e.g. less than 7%, 2 to 7% or around 2-5% on average.

Using a combination of the four digestion methods described above, a greater coverage of amino acid residues in SARS-CoV-2 proteins could be achieved. Accordingly, BPL-modifications were detected at the positions in the spike (S) and membrane (M) proteins shown in Table 11 below. The mean % occupancy at each site, as described in Example 7 above, is also shown in Table 11.

TABLE 11

BPL-modified sites identified in S protein and their occupancy

| Protein | Site Position | % occupancy |
|---|---|---|
| Spike-protein | H49 | 1% |
| Spike-protein | H146 | 2% |
| Spike-protein | C166 | 1% |
| Spike-protein | M177 | 6% |
| Spike-Protein | H207 | 1% |
| Spike-protein | H245 | 13% |
| Spike-protein | C432 | 8% |
| Spike-protein | H519 | 2% |
| Spike-protein | H625 | 7% |
| Spike-Protein | M1029 | 2% |
| Spike-Protein | H1058 | 11% |
| Spike-protein | H1083 | 3% |
| Spike-protein | H1088 | 4% |
| Spike-protein | H1101 | 1% |
| Spike-protein | H1159 | 4% |
| Spike-Protein | H1271 | 1% |
| Membrane protein | H125 | <10% |
| Membrane protein | H154 | <10% |
| Membrane protein | H155 | <10% |
| Membrane protein | H210 | <10% |

From the data in Table 11, it can be seen that up to around 16 residues in the spike (S) protein may be modified, and up to 4 residues in the membrane (M) protein. The occupancy at each site is low, e.g. less than 20%, typically less than 10%. Therefore the inactivated SARS-CoV-2 particles show a low degree of BPL-modifications.

Example 11. A Phase I/II Randomized, Dose-Finding Study to Evaluate the Safety, Tolerability and Immunogenicity of an Inactivated, Adjuvanted SARS-CoV-2 Virus Vaccine Candidate Against COVID-19 in Healthy Subjects A Phase I/II clinical study based on the methodology set out in Example 4 above was carried out. Thus the product composition is essentially as described in Examples 1 and 4 above. Three dose levels (low, medium and high) were studied, as described in Table 12 below. The dose levels (in AU/dose) may be determined by the SARS-CoV-2 ELISA assay as described in Example 1. For all dose levels, the adjuvant comprised 0.5 mg/dose aluminium hydroxide and 1 mg/dose CpG 1018.

TABLE 12

Product composition - 0.5 mL/dose

| Active substance | | Measured Antigen Units per dose in final product by ELISA |
|---|---|---|
| SARS-CoV-2 inactivated virus | Low dose | 3 AU |
| | Medium dose | 7 AU |
| | High dose | 35 AU |
| Excipients and buffer components | | |
| Aluminum hydroxide | All dose levels | 0.5 mg/dose |
| CpG 1018 | All dose levels | 1 mg/dose |
| Dulbecco's Phosphate Buffered Saline (DPBS)/Tris Buffered Saline[1] | | |
| rHA | All dose levels | <25 µg/dose |

[1]DPBS composition: 200 mg/mL KCl (2.68 mM), 200 mg/mL $KH_2PO_4$ (1.47 mM), 8000 mg/mL NaCl (136.9 mM), 2160 mg/mL $Na_2HPO_4*7H_2O$ (8.06 mM); Tris buffered saline: 20 mM Tris, 100 mM NaCl, pH 7.5.

Study Design

The study is a randomized, dose-escalation, multicenter study with three dose groups. Two doses were administered to each subject, 21 days apart (Day 1 and 22). The study population was approximately 150 healthy volunteers aged 18 to 55 years. The study is conducted in two Parts. Part A (covering the follow-up from Day 1 to Day 36) and Part B (covering the follow-up from Day 37 to Day 208). The study was carried out at 4 sites in the UK, Birmingham, Bristol, Newcastle, Southampton. The immunization route was intramuscular (i.m.).

Objectives

Primary Objective:

The primary objective of this study is to evaluate the safety, tolerability and immunogenicity of the inactivated, adjuvanted SARS-CoV-2 vaccine candidate up to 14 days after completion of a two-dose (Day 1 and 22) schedule in healthy adults aged 18 to 55 years.

Secondary Objectives:

To determine the optimal dose level of inactivated, adjuvanted SARS-CoV-2 vaccine candidate in healthy adults aged 18 to 55 years.

To evaluate tolerability, safety and immunogenicity of the inactivated, adjuvanted SARSCoV-2 vaccine candidate up to 6 months after the last vaccination in healthy adults aged 18 to 55 years.

TABLE 13

| Study endpoints | |
| --- | --- |
| Primary Endpoints | Secondary Endpoints |
| SAFETY<br>Frequency and severity of solicited adverse events (AEs) (local and systemic reactions) within 7 days after any vaccination. | SAFETY<br>Frequency and severity of any unsolicited AE until Day 36.<br>Frequency and severity of any vaccine-related AE until Day 36.<br>Frequency and severity of any AE until Day 208.<br>Frequency and severity of any vaccine-related AE until Day 208.<br>Frequency and severity of any SAE until Day 36.<br>Frequency and severity of any AESI until Day 36.<br>Frequency and severity of any SAE until Day 208.<br>Frequency and severity of an AESI until Day 208. |
| IMMUNOGENICITY<br>Geometric mean titre (GMT) for neutralizing antibodies against SARS-CoV-2 determined by wild-type virus microneutralizing assay at Day 36. | IMMUNOGENICITY<br>Immune response as measured by neutralizing antibody titers against SARS-CoV-2 on Day 8, Day 22, Day 106 and Day 208.<br>Proportion of subjects with seroconversion in terms of neutralizing antibodies on Day 8, Day 22, Day 36, Day 106 and Day 208.<br>Fold increase of SARS-CoV-2 neutralizing antibody titers on Day 8, Day 22, Day 36, Day 106 and Day 208 compared with baseline.<br>GMTs for IgG antibodies against SARS-CoV-2, determined by IgG S-ELISA, at Day 1, 8, 22, 36, 106 and 208.<br>Proportion of subjects with seroconversion in terms of IgG antibodies against SARS-CoV-2 as determined by ELISA on Day 8, Day 22, Day 36, Day 106 and Day 208. |

Results—Safety and Tolerability

Primary Endpoint:

Frequency and severity of solicited adverse events (AEs) (local and systemic reactions) within 7 days after each vaccination. Solicited injection site reactions include injection site pain, itching, tenderness, redness and swelling/induration. Solicited systemic reactions include fever/body temperature, fatigue, headache, nausea/vomiting, muscle pain.

Overall, 81.7% of participants reported at least one solicited reaction within 7 days after any vaccination.

47.7% (after first vaccination) and 51.3% (after second vaccination) of participants experienced a solicited injection site reaction.

52.3% (after first vaccination) and 52.0% (after second vaccination) of participants experienced a solicited systemic reaction.

All solicited AEs across the dose groups were assessed as mild or moderate with the exception of 3 events reported by 2 participants who experienced severe (Grade 3) solicited adverse events (one subject: severe headache and fatigue; one subject: severe fatigue). Both participants were in the high dose group.

Majority of solicited AEs resolved within 7 days post vaccination.

Solicited Local AEs:

Across all dose levels 66.7% of vaccinees reported at least one solicited injection site reaction (no statistical significant difference; p-value overall 0.631) with 68.6% in the low dose, 60.8% in the medium dose and 70.6% in the high dose group The most common injection site reaction after either vaccination was tenderness affecting 58.2% across dose groups and injection site pain 41.8% across dose groups.

Solicited Systemic AEs:

Across all dose levels 69.3% of vaccinees reported at least one solicited systemic reaction (no statistically significant difference between groups; p-value overall 0.507); the rate of vaccinees with solicited symptoms was 72.5% in both low and high dose and 62.7% in the medium dose group.

Overall, most frequently reported solicited systemic adverse events following vaccination included headache (46.4%), fatigue (39.2%) and muscle pain (32.7%).

Unsolicited AEs:

Overall, 39.2% of participants reported at least one unsolicited adverse event. No statistically significant differences between dose groups were observed.

All unsolicited adverse events were mild and moderate.

2 Cases of COVID-19 were confirmed by PCR up to Day 36. One mild case occurred in a participant of the medium dose group 16 days after the first vaccination. A moderate COVID-19 case was confirmed by PCR in a participant of the low dose group 4 days after the second vaccination.

Rates of unsolicited adverse events considered treatment-related up to Day 36 were 17.6% (27/153) with 23.5% in the low dose group, 13.7% in the medium dose group and 15.7% in the high dose group.

One adverse event of special interest has been reported (event term: chilblains); the event was assessed as mild and not-related to the study vaccination by the investigator.

AESI has been reported as serious adverse event as per protocol (medically important condition); no other serious adverse event has been reported.

Figure 23:
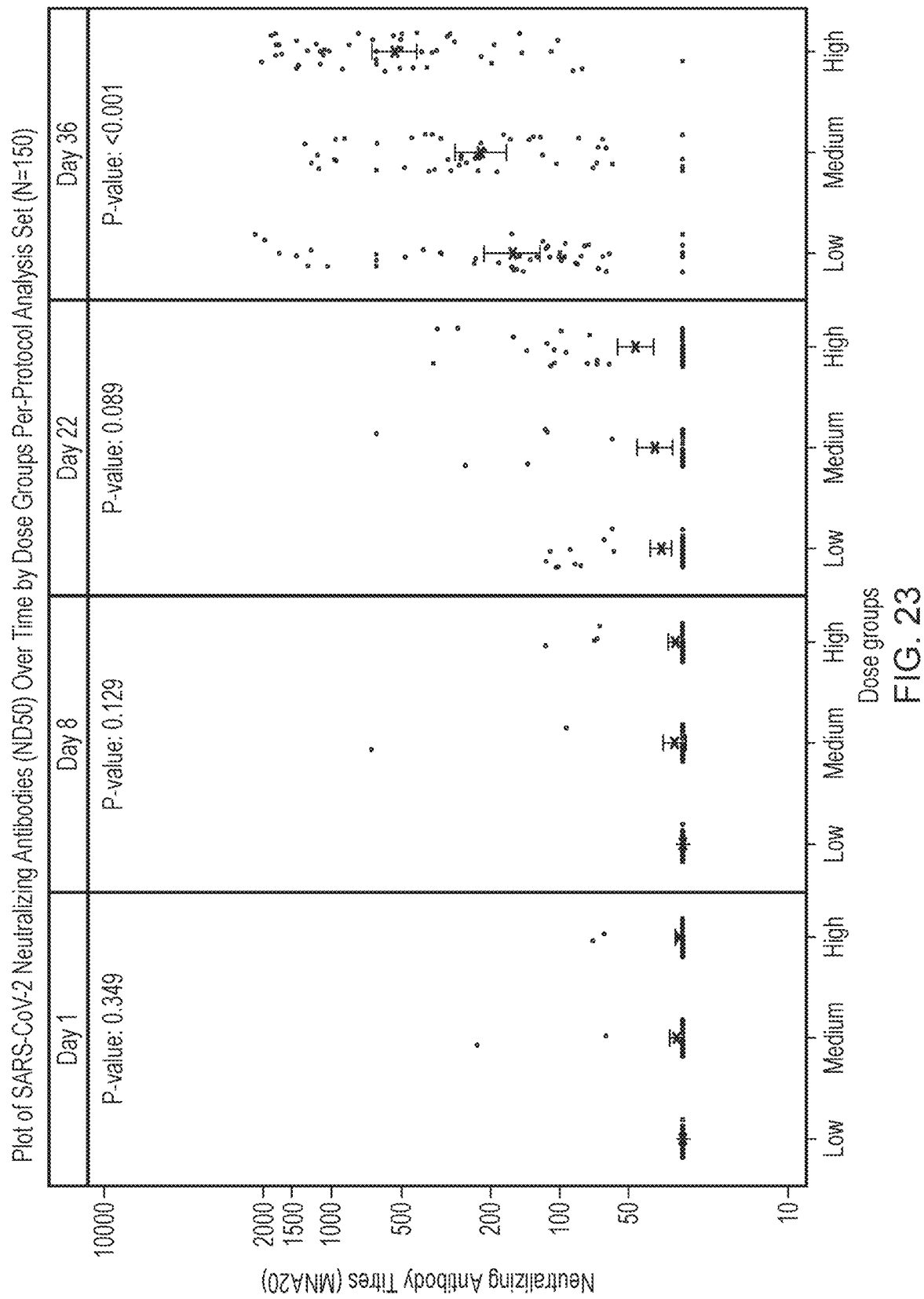
FIG. 23: Plot of SARS-CoV-2 neutralizing antibodies (MNA50) over time by dose groups per-protocol analysis set (N=150). Day 1: low (N=51), medium (N=49), and high (N=50). Day 8: low (N=51), medium (N=49), and high (N=50). Day 22: low (N=50), medium (N=48), and high (N=48). Day 36: low (N=51), medium (N=48), and high (N=50). Graph shows GMT and 95% CI. Scatter dots are the actual distribution of neutralizing antibody titres.
Figure 24:
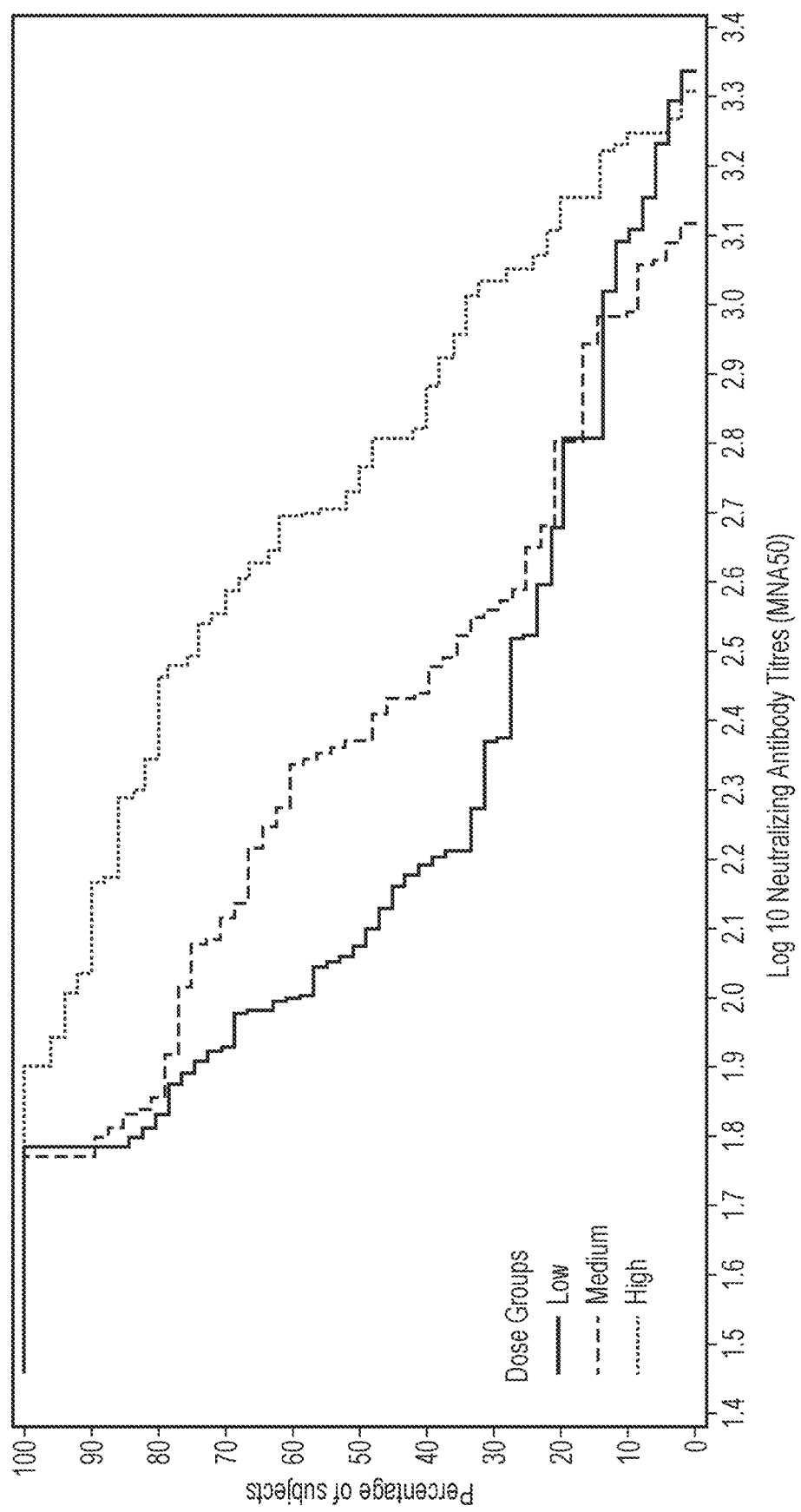
FIG. 24: Reverse cumulative distribution function for SARS-CoV-2 neutralizing antibody titres (ND50) for day 36 by dose groups per protocol analysis set (N=150). Low dose (N=51), medium dose (N=48) and high dose (N=50).
Figure 25:
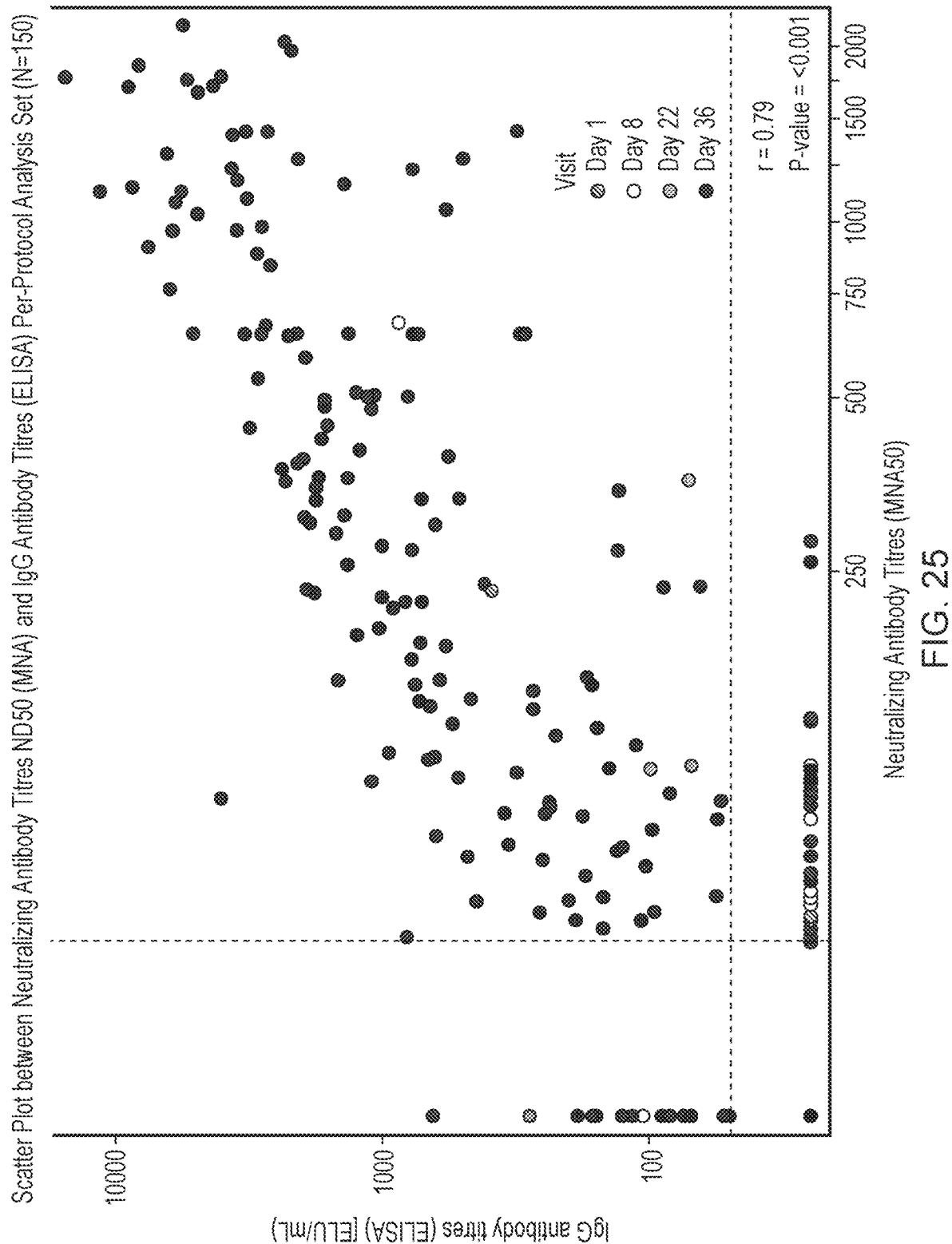
FIG. 25: Neutralization titer correlates with S-protein specific IgG. Scatter plot between neutralizing antibody titres ND50 (MNA) and IgG antibody titres (ELISA) per-protocol analysis set (N=150). Scatter plot shows correlation between results of ELISA (ELU/mL) and MNA (ND50). Pearson correlation coefficient (r) between ELISA (ELU/mL) and MNA(ND50) and P-value for testing the significance of correlation coefficient is also presented in the plot. Red dotted lines present the limit of detection for ELISA (50.3 ELU/mL) and MNA (ND50=58).
Figure 26:
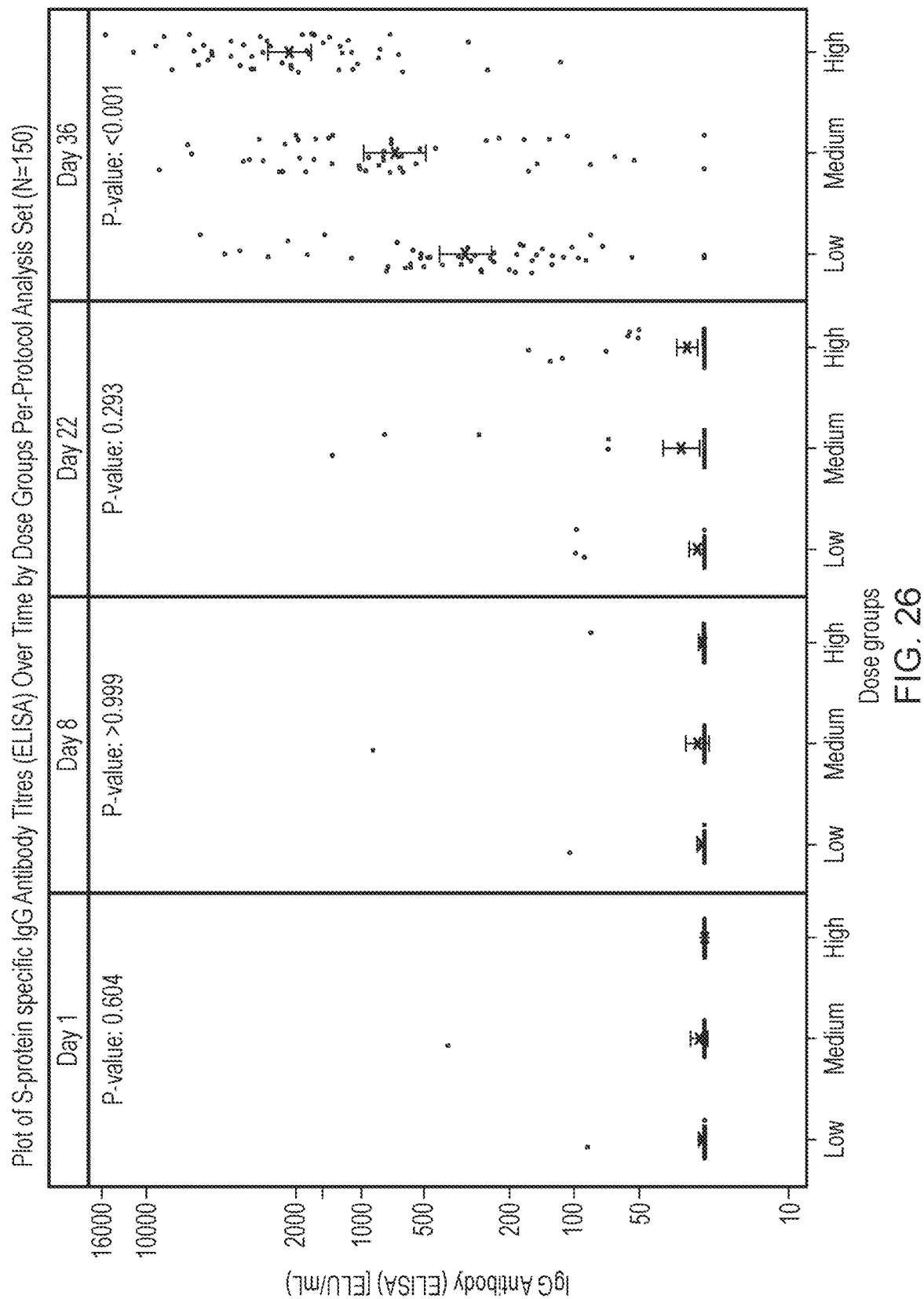
FIG. 26: Plot of S-protein specific IgG antibody titers (ELISA) over time by dose groups per-protocol analysis set (N=150). Day 1: low (N=51), medium (N=49), and high (N=50). Day 8: low (N=51), medium (N=49), and high (N=50). Day 22: low (N=51), medium (N=49), and high (N=50). Day 36: low (N=51), medium (N=49), and high (N=50). Graph shows GMT and 95% CI. Scatter dots are the actual distribution of IgG antibody titres.
Figure 27:
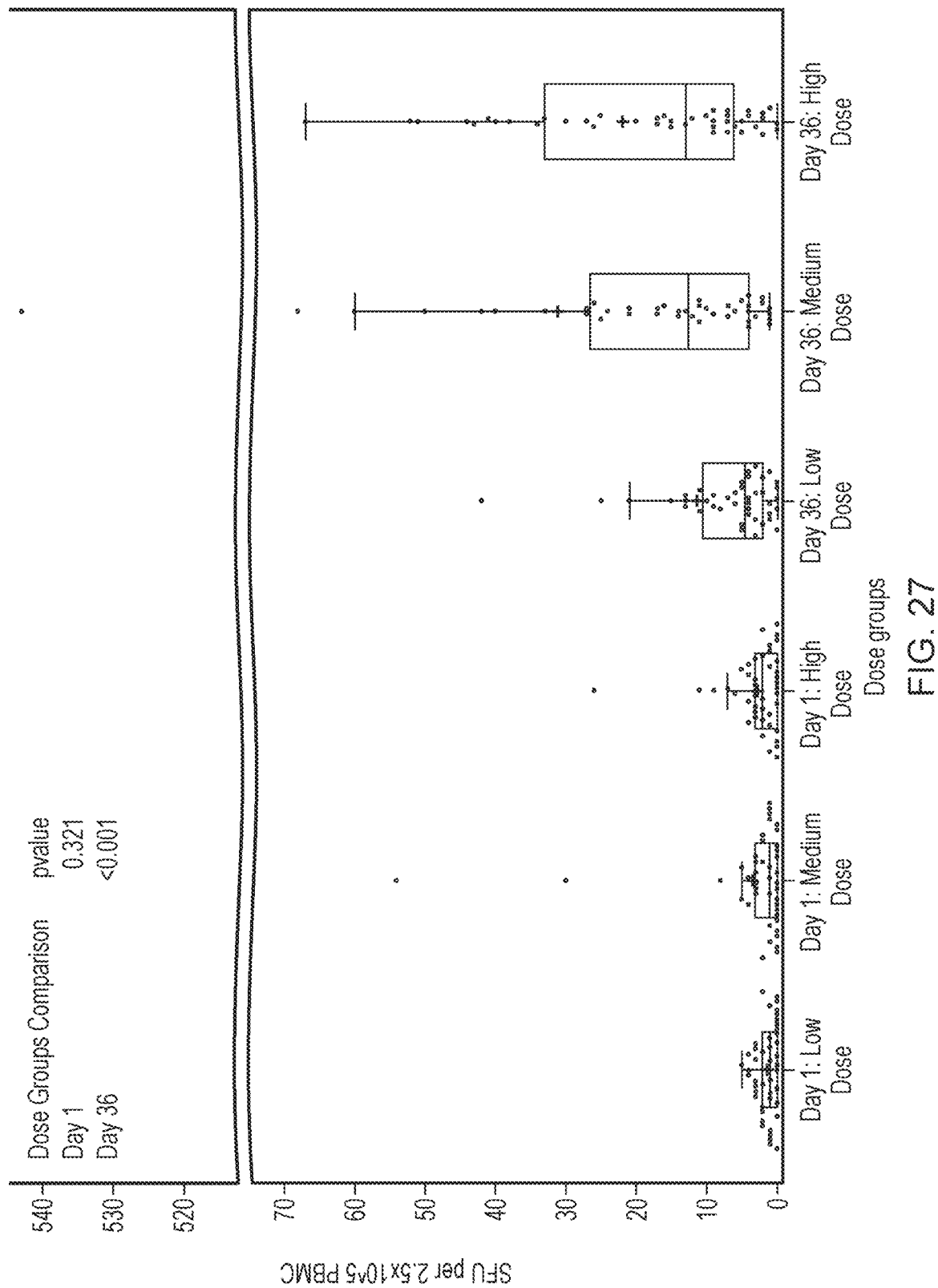
FIG. 27: Plot of IFN gamma spot forming units per $2\times10^5$ PBMC by dose groups and assessment days for panel 14 spike protein, full sequence (N=150). Dose groups comparison (pvalue): day 1 (p=0.321) and day 36 (p<0.001). Day 1: low (N=46), medium (N=43), and high (N=44). Day 36: low (N=44), medium (N=44), and high (N=45). The boxplots show the median, lower quartile and upper quartile. The horizontal line within each bar is the median and the plus sign (+) represents the mean value for each group. Scatter dots are the actual distribution of SFU per $2.5\times10^5$ PBMC within each group.
Figure 28:
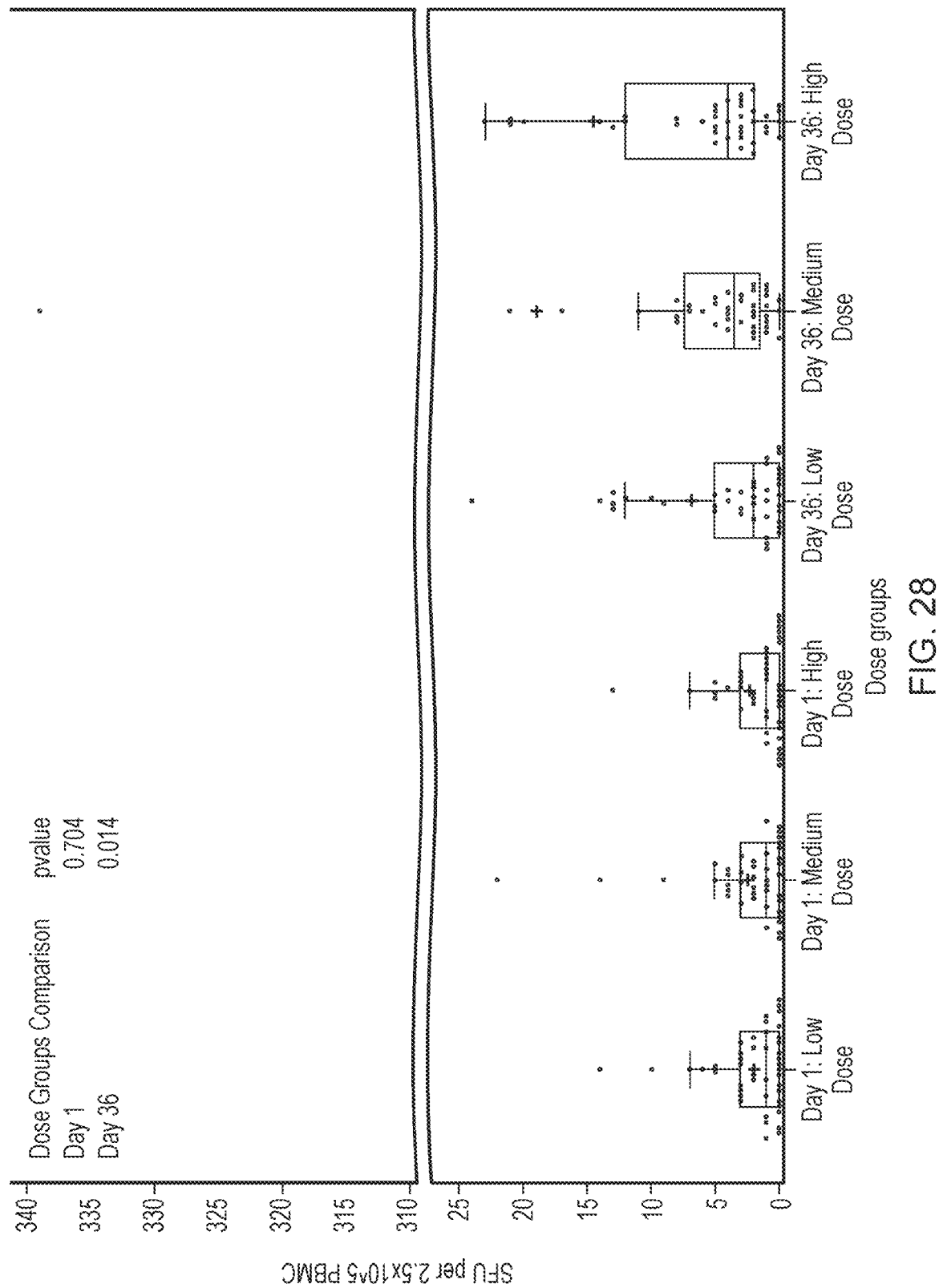
FIG. 28: Plot of IFN gamma spot forming units per $2\times10^5$ PBMC by dose groups and assessment days for membrane protein (N=150). Dose groups comparison (pvalue): day 1 (p=0.704), day 36 (p-0.014). Day 1: low (N=46), medium (N=43), and high (N=44). Day 36: low (N=44), medium (N=44), and high (N=45). The boxplots show the median, lower quartile and upper quartile; the horizontal line within each bar is the median and the plus (+) sign represents the mean value for each group. Scatter dots are the actual distribution of SFU per $2.5\times10^5$ PBMC within each group.
Figure 29:
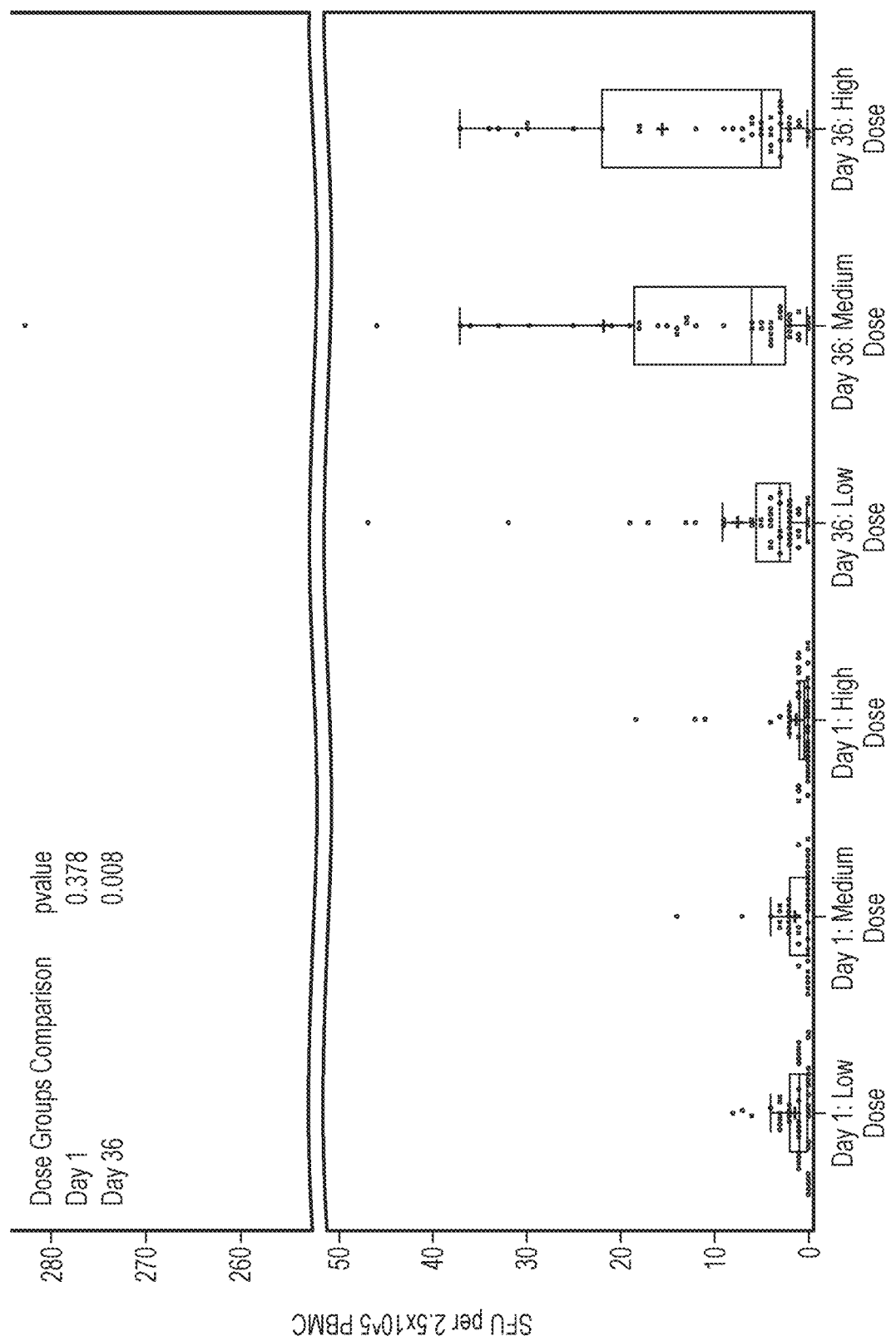
FIG. 29: Plot of IFN gamma spot forming units per $2\times10^5$ PBMC by dose groups and assessment days for nucleocapsid (N=150). Dose groups comparison (pvalue): day 1 (p=0.378), day 36 (p=0.008). Day 1: low (N=46), medium (N=43), and high (N=44). Day 36: low (N=44), medium (N=44), and high (N=45). The boxplots show the median, lower quartile and upper quartile. The horizontal line within each bar is the median and the plus (+) sign represents the mean value for each group. Scatter dots are the actual distribution of SFU per $2.5\times10^5$ PBMC within each group.

Conclusions—Safety and Tolerability
  The vaccine candidate was generally safe and well tolerated across all dose groups tested, with no safety concerns identified by an independent Data Safety Monitoring Board.
  There were no statistically significant differences between dose groups and no differences between first and second vaccinations in terms of reactogenicity.
  The majority of Adverse Events (AEs) were mild or moderate and only two subjects reported severe solicited AEs (headache and fatigue).
  All solicited AEs resolved quickly.
  Only 17.6% of unsolicited adverse events up to day 36 were considered related to the vaccine and no severe unsolicited AEs were reported.
  There were no serious related AEs.
Results—Immunogenicity
  Neutralizing Antibodies as Measured by MNA50
  Neutralizing antibodies were measured by a microneutralization assay (MNA50). Vero/E6 cells are seeded at $2.5 \times 10^5$ cells/mL in 100 µl/well in a microtiter plate and incubated at 37° C. overnight. Serum samples from subjects were heat inactivated at 56° C. for 30 minutes. The neutralization plate comprising virus and serum samples is prepared at 37° C. for 1-1.5 hours. The neutralized virus is then transferred to the Vero/E6 cells in the microtiter plate and incubated at 37° C. for 1-1.5 hours. Cells are overlayed in 2% CMC in 2×MEM and incubated at 37° C. for 22-26 hours. Cells are fixed with 10% formalin at room temperature for >8 hours. Plaques are then visualized with a SARS-CoV-2 RBD spike antibody, detected by a secondary antibody and HRP-polymer. Pfu/well are counted and used to calculate the $ND_{50}$.
    A clear dose dependent response was observed with the highest Geometric Mean Titre (GMT) for neutralizing antibodies in the high dose group at both Day 22 (GMT 46.5; 95% CI: 38.79, 55.66)) and Day 36 (GMT 530.4; 95% CI: 421.49, 667.52)—see FIG. 23.
    On Day 36, the GMT of the high dose group was statistically significantly higher than each of the other dose groups. GMT in the low dose was 161.1 (95% CI: 121.35, 213.82) and in medium dose group, 222.3 (95% CI: 171.84, 287.67)+
    GMT-fold increases for neutralizing antibodies at Day 36 were 5.55 (95% CI: 4.18, 7.37) in the low dose, 7.22 (95% CI: 5.64, 9.25) in the medium dose and 17.68 (95% CI: 14.04, 22.26) in the high dose group.
    On Day 22, prior to the second study vaccination, the number of participants with seroconversion for neutralizing antibodies (defined as ≥4-fold increase from baseline) was 10.0% (5/50 participants)
    At Day 36, 90.0% (95% CI: 0.78, 0.97) of participants in the high dose group, were seroconverted which was statistically significantly higher compared to the low dose (51.0%; 95% CI: 0.37, 0.65) and medium dose group (73.5%; 95% CI: 0.59, 0.85)— see FIG. 24.
  S-Protein Binding Antibodies as Measured by IgG ELISA
  S-protein-binding antibodies were detected by a SARS-CoV-2 spike IgG ELISA. The ELISA plate is coated with a Spike protein (Wuhan). Anti-S protein antibodies in the serum sample bind to the immobilized Spike protein antigen, and are detected by a secondary (peroxidase-conjugated) anti-human IgG antibody. Results are presented as ELISA laboratory units per mL (ELU/mL). A commercially available human serum screened for high pre-existing S antibody titers is used as a control.
    The S-protein IgG antibody titers correlated with neutralization titers (r=0.79, p<0.001)—see FIG. 25.
    Similar to the neutralization titer, a clear dose dependent response was observed with the highest GMT for neutralizing antibodies in the high dose group at both Day 22 (GMT 30.0 (95% CI: 26.92, 33.48)) and Day 36 (GMT 2147.9 (95% CI: 1705.98, 2704.22))—see FIG. 26.
    On Day 36, the GMT of the high dose group was statistically significantly higher than each of the other dose groups. GMT in the low dose was 325.1 (95% CI: 245.45, 430.46) and in the medium dose group 691.6 (95% CI: 494.91, 966, 52)
    GMFR for S-protein binding antibodies at Day 36 were 12.69 (95% CI: 9.54, 16.88) in the low dose, 26.16 (95% CI: 18.73, 36.53) in the medium dose and 85.91 (95% CI: 68.24, 108.17) in the high dose group.
    At Day 36, 100% (95% CI: 0.93, 1.00) of participants in the high dose group were seroconverted and 89.3% (95% CI: 0.78, 0.97) in the medium dose group as well as 84.3% (95% CI: 0.71, 0.93) (p=0.053 compared to high dose) in the low dose group (p=0.017 compared to high dose).
  Cellular Response:
  Exploratory endpoints evaluated T-cell responses by IFN-gamma ELISpot analysis against S-protein, Membrane-protein and Nucleocapsid-protein. Isolated PBMCs (fresh) are stimulated with SARS-CoV-2 peptides from the S, M and N proteins. Interferon-gamma production by T cells is detected by an anti-IFNγ antibody and visualized with a labelled secondary antibody. Spots are thus produced where interferon-gamma was released by activated T cells. A nil control and phytohemagglutinin (PHA) control are used. A 6 spot reactivity cut off was used, i.e. a sample is considered reactive against an individual stimulation panel (peptide pools) if normalized spot counts (Nil control counts subtracted) per $2.10 \times 10^5$ PBMCs ≥6.
    At Day 36 in the high dose group, 76% of study participants (34/45) were reactive against peptide pools spanning the full-length S-protein (see FIG. 27), 36% (16/45) against the M-protein (see FIG. 28) and 49% (22/45) against the N-protein (see FIG. 29).
Conclusions—Immunogenicity
  The vaccine candidate was highly immunogenic with more than 90% of all study participants developing significant levels of antibodies to the SARS-CoV-2 virus spike protein across all dose groups tested.
  Seroconversion Rates (SCR) for S-protein binding IgG antibodies were 89.8% in the medium dose and 100% in the high dose group.
  Two weeks after completion of the two dose schedule, Geometric Mean Fold Rises (GMFRs) from baseline were 26 in the medium dose and 86 in the high dose group.
  Of note, the IgG antibody response was highly correlated with neutralization titres (MNA50) (r=0.79, p<0.001).
  The vaccine candidate induced a dose dependent response with statistically significant higher Geometric Mean Titres (GMTs) for both IgG and neutralizing antibodies in the high dose group compared to the low and medium dose groups.
  In the high dose group, the GMT of neutralizing antibodies antibody titres measured 2 weeks after completion of the 2-dose schedule was at or above levels for a panel of convalescent sera (GMT 530.4 (95% CI: 421.49, 667.52)).

With a GMT ratio of vaccine vs. convalescent sera ≥1 vaccine efficacy has been reported above 80% for other vaccines*).

*) Earle et al. MedRxiv, March 2021, doi.org/10.1101/2021.03.17.20200246); Khoury et al. MedRxiv, March 2021, doi.org/10.1101/2021.03.09.21252641

The vaccine candidate induced broad T-cell responses across participants with antigen-specific IFN-gamma producing T-cells against the S-protein, M and N protein detected in 75.6%, 35.6% and 48.9% of study participants, respectively.

ADDITIONAL ASPECTS OF THE INVENTION

In further aspects, the present invention provides:

A1. A SARS-CoV-2 vaccine comprising an optimally (e.g. wherein the native surface of the S-protein is preserved) inactivated SARS-CoV-2 particle, wherein the SARS-CoV-2 particle is able to seroconvert a subject that is administered the SARS-CoV-2 vaccine with at least a 70% probability.

A2. The SARS-CoV-2 vaccine of aspect A1, wherein the SARS-CoV-2 particle is able to seroconvert the subject that is administered the SARS-CoV-2 vaccine with at least 80%, 85%, 90%, or 95% probability.

A3. The vaccine of aspect A1 or A2, wherein the SARS-CoV-2 particle has a RNA genome corresponding to the DNA sequence provided by any one of the nucleic acid sequences of SEQ ID NO: 1 (see Genbank NC_045512.2), or a variant nucleic acid sequence that is at least 85% identical to SEQ ID NO: 1 and able to pack a virulent SARS-CoV-2; or SEQ ID NO: 9 (see NCBI MT066156), or a variant nucleic acid sequence that is at least 85% identical to SEQ ID NO: 1 and able to pack a virulent SARS-CoV-2; or SEQ ID NO: 18 (see NCBI MW598408). or a variant nucleic acid sequence that is at least 85% identical to SEQ ID NO: 18 and able to pack a virulent SARS-CoV-2; or SEQ ID NO: 20 (see NCBI MW520923). or a variant nucleic acid sequence that is at least 85% identical to SEQ ID NO: 20 and able to pack a virulent SARS-CoV-2; or SEQ ID NO: 22 (see NCBI MW422256). or a variant nucleic acid sequence that is at least 85% identical to SEQ ID NO: 22 and able to pack a virulent SARS-CoV-2; or SEQ ID NO: 22 (see NCBI MW422256). or a variant nucleic acid sequence that is at least 85% identical to SEQ ID NO: 24 and able to pack a virulent SARS-CoV-2; or SEQ ID NO: 22 (see NCBI MW422256). or a variant nucleic acid sequence that is at least 85% identical to SEQ ID NO: 26 and able to pack a virulent SARS-CoV-2.

A4. The vaccine of any one of aspects A1-A3, wherein the SARS-CoV-2 particle has an S protein as defined by the amino acid sequence SEQ ID NO: 3, or a variant amino acid sequence that is at least 95% identical to SEQ ID NO: 3 and able to pack a virulent SARS-CoV-2; or SEQ ID NO: 11, or a variant amino acid sequence that is at least 95% identical to SEQ ID NO: 3 and able to pack a virulent SARS-CoV-2; or SEQ ID NO: 19, or a variant amino acid sequence that is at least 95% identical to SEQ ID NO: 3 and able to pack a virulent SARS-CoV-2; or SEQ ID NO: 21, or a variant amino acid sequence that is at least 95% identical to SEQ ID NO: 3 and able to pack a virulent SARS-CoV-2; or SEQ ID NO: 23, or a variant amino acid sequence that is at least 95% identical to SEQ ID NO: 3 and able to pack a virulent SARS-CoV-2; or SEQ ID NO: 25, or a variant amino acid sequence that is at least 95% identical to SEQ ID NO: 3 and able to pack a virulent SARS-CoV-2; or SEQ ID NO: 27, or a variant amino acid sequence that is at least 95% identical to SEQ ID NO: 3 and able to pack a virulent SARS-CoV-2.

A5. The SARS-CoV-2 vaccine of any one of aspects A1-A4, wherein the SARS-CoV-2 particle has a polyprotein selected from the amino acid sequences provided by any one of SEQ ID NOs: 2, 10, 13 or 16, preferably SEQ ID NO: 10, or a variant amino acid sequence that is at least 95% identical to any one of SEQ ID NOs: 2, 10, 13 or 16, preferably SEQ ID NO: 10, and able to pack a virulent SARS-CoV-2.

A6. The SARS-CoV-2 vaccine of any one of aspects A1-A5, wherein the SARS-CoV-2 is inactivated by chemical inactivation, thermal inactivation, pH inactivation, UV inactivation or radiation inactivation.

A7. The SARS-CoV-2 vaccine of aspect A6, wherein the chemical inactivation comprises contacting the SARS-CoV-2 particles with a chemical inactivation agent for longer than is required to completely inactivate the SARS-CoV-2 as measured by plaque assay or as measured by plaque assay plus one day.

A8. The SARS-CoV-2 vaccine of aspect A7, wherein the chemical inactivation comprises contacting the SARS-CoV-2 particle with formaldehyde and/or beta-propiolactone, preferably beta-propiolactone.

A9. The SARS-CoV-2 vaccine of aspect A8, wherein the formaldehyde and/or beta-propiolactone inactivation comprises contacting the SARS-CoV-2 particle with formaldehyde and/or beta-propiolactone for between 2-10 days.

A10. The SARS-CoV-2 vaccine of any one of aspects A6-A9, wherein the chemical activation is performed at about 4° C. or about 22° C.

A11. The SARS-CoV-2 vaccine of any one of aspects A1-A10, further comprising an adjuvant.

A12. The SARS-CoV-2 vaccine of aspect A11, wherein the adjuvant is a CpG, preferably CpG 1018, optionally also comprising an aluminium salt adjuvant.

A13. The SARS-CoV-2 vaccine of aspect A12, wherein the aluminium salt adjuvant is aluminium hydroxide or aluminium phosphate salt.

A14. The SARS-CoV-2 vaccine of aspect A13, wherein the aluminium hydroxide comprises less than 1.25 ppb Cu.

A15. The SARS-CoV-2 vaccine of any one of aspects A12 to A14, wherein the alum:CpG (w/w) ratio is about 1:10, about 1:5, about 1:4, about 1:3, about 1:2, about 1:1, about 2:1, about 3:1, about 4:1, about 5:1, about 10:1, preferably between about 1:3 and 3:1, more preferably between about 1:2 and 1:1, most preferably about 1:2.

A16. The SARS-CoV-2 vaccine according to any one of aspects A12 to A14, wherein the amount of free (unbound) CpG in the vaccine composition is greater than 10%, greater than 20%, greater than 30%, greater than 40%, greater than 50%, greater than 60%, greater than 70%, greater than 80%, greater than 90%, greater than 95%, preferably about 70% to 95%, most preferably about 80% to 90%.

A17. The SARS-CoV-2 vaccine according to any one of aspects A1 to A16, wherein the vaccine composition comprises at least one buffer, preferably a phosphate buffer.

A18. The SARS-CoV-2 vaccine of any one of A11-A13, wherein the vaccine comprises or further comprises an adjuvant comprising a peptide and a deoxyinosine-containing immunostimulatory oligodeoxynucleic acid molecule (I-ODN).

A19. The SARS-CoV-2 vaccine of aspect A18, wherein the peptide comprises the sequence KLKL$_5$KLK (SEQ ID NO: 5) and the I-ODN comprises oligo-d(IC)$_{13}$ (SEQ ID NO: 6).

A20. The SARS-CoV-2 vaccine of any one of aspects A1-A19, further comprising one or more pharmaceutically acceptable excipients.

B1. A kit comprising a SARS-CoV-2 vaccine of any one of aspects A1-A15.

B2. The kit of aspect B1, further comprising a second vaccine.

B3. The kit of aspect B2, wherein the second vaccine is another SARS-CoV-2 virus vaccine (e.g. of another technology such as mRNA or adenovirus vectored), an influenza virus vaccine or a Chikungunya virus vaccine.

C1. A method, comprising administering a first dose of a prophylactically or therapeutically effective amount of the SARS-CoV-2 vaccine of any one of aspects A1-A15 to a subject in need thereof.

C2. The method of aspect C1, further comprising administering a second dose of a prophylactically or therapeutically effective amount of the SARS-CoV-2 vaccine.

C3. The method of aspect C1 or C2, wherein the second dose of the SARS-CoV-2 vaccine is administered about 7 days after the first dose of the SARS-CoV-2 vaccine.

C4. The method of aspect C1 or C2, wherein the second dose of the SARS-CoV-2 vaccine is administered about 14 days after the first dose of the SARS-CoV-2 vaccine.

C5. The method of aspect C1 or C2, wherein the second dose of the SARS-CoV-2 vaccine is administered about 21 days after the first dose of the SARS-CoV-2 vaccine.

C6. The method of aspect C1 or C2, wherein the second dose of the SARS-CoV-2 vaccine is administered about 28 days after the first dose of the SARS-CoV-2 vaccine.

C7. The method of any one of aspects C1-C6, wherein the administering results in production of SARS-CoV-2 neutralizing antibodies.

C8. The method of any one of aspects C1-C7, wherein the prophylactically or therapeutically effective amount of the SARS-CoV-2 vaccine is defined as about 0.01 to 25 mAU (milli-absorption units×minutes), preferably about 0.05 to 10 mAU, more preferably about 0.1 to 5 mAU, most preferably about 0.25 to 2.5 mAU, as assessed by SE-HPLC.

C9. The method of any one of aspects C1-C7, wherein the prophylactically or therapeutically effective amount of the SARS-CoV-2 vaccine is defined as about 0.05 to 50 μg total protein, about 0.1 to 25 μg, about 0.25 to 12.5 μg, preferably about 0.5 to 5 μg total protein, as measured by (μ)BCA.

C10. The method of any one of aspects C1-C7, wherein the prophylactically or therapeutically effective amount of the SARS-CoV-2 vaccine is defined as about 0.025 to 25 μg S-protein, about 0.05 to 12.5 μg, about 0.125 to 6.25 μg, preferably about 0.25 to 2.5 μg S-protein, as measured by ELISA.

D1. A method of producing a SARS-CoV-2 vaccine, comprising
(i) passaging a SARS-CoV-2 on Vero cells, thereby producing a culture medium comprising the SARS-CoV-2;
(ii) harvesting the culture medium of (i);
(iii) precipitating the harvested culture medium of (ii), thereby producing a SARS-CoV-2 supernatant; and
(iv) optimally inactivating the SARS-CoV-2 in the SARS-CoV-2 supernatant of (iii) thereby producing an inactivated SARS-CoV-2.

D2. The method of aspect D1, further comprising concentrating the culture medium of (ii) prior to step (iii).

D3. The method of aspect D1 or D2, wherein the precipitation of (iii) comprises contacting the culture medium of (ii) with protamine sulfate or benzonase.

D4. The method of any one of aspects D1-D3, further comprising (v) dialyzing the inactivated SARS-CoV-2 of (iv), thereby producing a dialyzed SARS-CoV-2.

D5. The method of aspect D4, further comprising (vi) filtering the dialyzed SARS-CoV-2 of (v).

D6. The method of any one of aspects D1-D5, wherein the inactivating is by chemical inactivation, thermal inactivation, pH inactivation, or UV inactivation.

D7. The method of aspect D6, wherein the chemical inactivation comprises contacting the SARS-CoV-2 particle with a chemical inactivation agent for at least 4 days.

D8. The method of aspect D6 or D7, wherein the chemical inactivation agent comprises formaldehyde.

D9. The method of any one of aspects D6-D8, wherein the chemical activation is performed at about 4° C. or about 22° C.

D10. The method of aspect D8 or D9, further comprising neutralizing the formaldehyde.

D11. The method of aspect D10, wherein the neutralizing is performed with sodium metabisulfite.

D12. The method of any one of aspects D1-D11, wherein the chemical inactivation is performed with BPL, preferably at a concentration of 300 to 700 ppm, more preferably 500 ppm and inactivated for about 1 to 48 h, preferably 20 to 28 h, most preferred 24 hours±2 hours (such as also ±1 hour or ±0.5 hour) at 2° C. to 8° C.

D13. The method of aspect D12, wherein the chemical inactivation is followed by a hydrolyzation step for 2.5 hours±0.5 hours at 35° C. to 39° C., preferably around 37° C.

E1. The use of the optimally inactivated SARS-CoV-2 vaccine of any one of aspects A1-A15 for the treatment and prevention of a SARS-CoV-2 infection.

E2. The use of aspect E1, wherein the inactivated SARS-CoV-2 vaccine is administered in a first dose of a therapeutically effective amount to a subject in need thereof.

E3. The use of aspect E2, wherein the inactivated SARS-CoV-2 vaccine is administered in a second dose of a therapeutically effective amount to the subject.

E4. The use of aspect E3, wherein the second dose of the inactivated SARS-CoV-2 vaccine is administered about 7 days after the first dose of the SARS-CoV-2 vaccine.

E5. The use of aspect E3, wherein the second dose of the SARS-CoV-2 vaccine is administered about 14 days after the first dose of the SARS-CoV-2 vaccine.

E6. The use of aspect E3, wherein the second dose of the SARS-CoV-2 vaccine is administered about 21 days after the first dose of the SARS-CoV-2 vaccine.

E7. The use of aspect E3, wherein the second dose of the SARS-CoV-2 vaccine is administered about 28 days after the first dose of the SARS-CoV-2 vaccine.

E8. The use of any one of aspects E1-E6, wherein the administering results in production of SARS-CoV-2 neutralizing antibodies.

F1. A pharmaceutical composition for use in the treatment and prevention of a SARS-CoV-2 infection, wherein said pharmaceutical composition comprises the optimally inactivated SARS-CoV-2 vaccine of any one of aspects A1-A15.

F2. The pharmaceutical composition of aspect F1, wherein the inactivated SARS-CoV-2 vaccine is administered in a first dose of a therapeutically effective amount to a subject in need thereof.

F3. The use of aspect F2, wherein the inactivated SARS-CoV-2 vaccine is administered in a second dose of a therapeutically effective amount to the subject.

F4. The use of aspect F3, wherein the second dose of the inactivated SARS-CoV-2 vaccine is administered about 7 days after the first dose of the SARS-CoV-2 vaccine.

F5. The use of aspect F3, wherein the second dose of the SARS-CoV-2 vaccine is administered about 14 days after the first dose of the SARS-CoV-2 vaccine.

F6. The use of aspect F3, wherein the second dose of the SARS-CoV-2 vaccine is administered about 21 days after the first dose of the SARS-CoV-2 vaccine.

F7. The use of aspect F3, wherein the second dose of the SARS-CoV-2 vaccine is administered about 28 days after the first dose of the SARS-CoV-2 vaccine.

F8. The use of any one of aspects F1-F6, wherein the administering results in production of SARS-CoV-2 neutralizing antibodies.

G1. A SARS-CoV-2 vaccine comprising an effective amount of antigen, wherein said effective amount is able to seroconvert a subject that is administered the SARS-CoV-2 vaccine with at least a 70% probability.

G2. The SARS-CoV-2 vaccine according to aspect G1, wherein said effective amount is able to seroconvert a subject that is administered the SARS-CoV-2 vaccine with at least 80%, 85%, 90%, or 95% probability.

G3. The SARS-CoV-2 vaccine according to aspect G1 or G2, wherein said effective amount is between about 1 to 100 AU/dose, preferably between about 2 to 75 AU/dose, preferably between about 3 and 60 AU/dose, more preferably between about 3 and 55 AU/dose, more preferably between about 3 and 53 AU/dose.

G4. The SARS-CoV-2 vaccine according to aspect G3, where said effective amount is determined by ELISA wherein the antigen units (AU) correspond to ACE-2 binding capacity of the spike protein used as a standard.

H1. An immunogenic composition for stimulating an immune response against a severe acute respiratory syndrome coronavirus 2 (SARS-CoV-2), comprising a SARS-CoV-2 antigen and a toll-like receptor 9 (TLR9) agonist, wherein the SARS-CoV-2 antigen is an inactivated whole SARS-CoV-2, the TLR9 agonist is an oligonucleotide of from 10 to 35 nucleotides in length comprising an unmethylated cytidine-phospho-guanosine (CpG) motif, and the SARS-CoV-2 antigen and the oligonucleotide are present in the immunogenic composition in amounts effective to stimulate an immune response against the SARS-CoV-2 antigen in a mammalian subject.

H2. The composition of aspect H1, wherein the oligonucleotide comprises the sequence 5'-AACGTTCGAG-3' (SEQ ID NO:30).

H3. The composition of aspect H1, wherein the oligonucleotide comprises the sequence of 5'-TGACTGTGAACGTTCGAGAT GA-3' (SEQ ID NO: 4).

H4. The composition of any one of aspects H1-3, wherein the oligonucleotide comprises a modified nucleoside, optionally wherein the modified nucleoside is selected from the group consisting of 2'-deoxy-7-deazaguanosine, 2'-deoxy-6-thioguanosine, arabinoguanosine, 2'-deoxy-2' substituted-arabinoguanosine, and 2'-O-substituted-arabinoguanosine.

H5. The composition of aspect H4, wherein the oligonucleotide comprises the sequence 5'-TCG$_1$AACG$_1$TTCG$_1$-3' (SEQ ID NO: 31) in which G$_1$ is 2'-deoxy-7-deazaguanosine, optionally wherein the oligonucleotide comprises the sequence 5'-TCG$_1$AACG$_1$TTCG$_1$-X-G$_1$CTTG$_1$CAAG$_1$CT-5' (SEQ ID NO: 32), and in which G$_1$ is 2'-deoxy-7-deazaguanosine and X is glycerol (5'-SEQ ID NO: 31-3'-X-3'-SEQ ID NO: 31-5').

H6. The composition of any one of aspects H1-5, wherein the oligonucleotide comprises at least one phosphorothioate linkage, or wherein all nucleotide linkages are phosphorothioate linkages.

H7. The composition of any one of aspects H1-6, wherein the oligonucleotide is a single-stranded oligodeoxynucleotide.

H8. The composition of any one of aspects H1-7, wherein a 0.5 ml dose of the immunogenic composition comprises from about 750 to about 3000 μg of the oligonucleotide, or wherein the immunogenic composition comprises about 750 μg, about 1000 μg, about 1500 μg, or about 3000 μg of the oligonucleotide.

H9. The composition of any one of aspects H1-8, wherein the SARS-CoV-2 antigen is propagated in vitro in mammalian cells.

H10. The composition of any one of aspects H1-9, wherein the SARS-CoV-2 is inactivated by treatment with one or both of formalin and ultraviolet light.

H11. The composition of any one of aspects H1-9, wherein the SARS-CoV-2 is inactivated by treatment with beta-propiolactone.

H12. The composition of any one of aspects H1-11, wherein the SARS-CoV-2 comprises a combination of at least two different viral strains, or from two different viral clades or lineages.

H13. The composition of any one of aspects H1-12, wherein a 0.5 ml dose of the immunogenic composition comprises from about 0.025 to about 25 μg of the of the SARS-CoV-2 spike (S) protein, or from about 0.25 to about 25 μg of the of the S protein.

H14. The composition of any one of aspects H1-13, further comprising an aluminum salt adjuvant.

H15. The composition of aspect H14, wherein the aluminum salt adjuvant comprises one or more of the group consisting of amorphous aluminum hydroxyphosphate sulfate, aluminum hydroxide, aluminum phosphate, and potassium aluminum sulfate H16. The composition of aspect H14, wherein the aluminum salt adjuvant comprises aluminum hydroxide.

H17. The composition of any one of aspects H14-16, wherein a 0.5 ml dose of the immunogenic composition comprises from about 0.05 to about 0.50 mg Al3+, or about 0.075 to about 0.175 mg Al3+, or from about 0.25 to about 0.50 mg Al3+, or about 0.375 mg Al3+.

H18. The composition of any one of aspects H1-17, wherein the mammalian subject is a human subject.

H19. A kit comprising:
i) the immunogenic composition of any one of aspects H1-18, and
ii) instructions for administration of the composition to stimulate an immune response against the SARS-CoV-2 antigen in the mammalian subject.

H20. The kit of aspect H19, further comprising iii) a syringe and needle for intramuscular injection of the immunogenic composition.

H21. A method for stimulating an immune response against a severe acute respiratory syndrome coronavirus 2 (SARS-CoV-2) in a mammalian subject, comprising administering the immunogenic composition of any one of aspects H1-18 to a mammalian subject so as to stimulate an immune response against the SARS-CoV-2 antigen in the mammalian subject.

H22. The method of aspect H21, wherein the mammalian subject is a human subject and/or the immunogenic composition is administered by intramuscular injection.

H23. Use of the immunogenic composition of any one of aspects H1-18 for stimulating an immune response against a severe acute respiratory syndrome coronavirus 2 (SARS-CoV-2) in a mammalian subject, the method comprising administering to the subject an effective amount of the immunogenic composition.

H24. Use of the immunogenic composition of any one of aspects H1-18 for protecting a mammalian subject from infection with severe acute respiratory syndrome coronavirus 2 (SARS-CoV-2), the method comprising administering to the subject an effective amount of the immunogenic composition.

H25. Use of the immunogenic composition of any one of aspects H1-18 for preventing a mammalian subject from contracting COVID-19 disease, the method comprising administering to the subject an effective amount of the immunogenic composition.

H26. The use of any one of aspects H23-25, wherein the mammalian subject is a human subject and/or the immunogenic composition is administered by intramuscular injection.

In some specific embodiments, there is provided an aspect of the invention as described herein (e.g. as in one or more of aspects A to H above, or as in the appended claims), wherein one or more of the following aspects (labelled X) is excluded:

X1. An immunogenic composition for stimulating an immune response against a severe acute respiratory syndrome coronavirus 2 (SARS-CoV-2), comprising a SARS-CoV-2 antigen and a toll-like receptor 9 (TLR9) agonist, wherein the TLR9 agonist is an oligonucleotide of from 10 to 35 nucleotides in length comprising an unmethylated cytidine-phospho-guanosine (CpG) motif, and the SARS-CoV-2 antigen and the oligonucleotide are present in the immunogenic composition in amounts effective to stimulate an immune response against the SARS-CoV-2 antigen in a mammalian subject.

X2. The composition of aspect X1, wherein the oligonucleotide comprises the sequence 5'-AACGTTCGAG-3' (SEQ ID NO: 30).

X3. The composition of aspect X1, wherein the oligonucleotide comprises the sequence of 5'-TGACTGTGAACGTTCGAGATGA-3' (SEQ ID NO: 4).

X4. The composition of aspect X1, wherein the oligonucleotide comprises a modified nucleoside, optionally wherein the modified nucleoside is selected from the group consisting of 2'-deoxy-7-deazaguanosine, 2'-deoxy-6-thioguanosine, arabinoguanosine, 2'-deoxy-2' substituted-arabinoguanosine, and 2'-O-substituted-arabinoguanosine.

X5. The composition of aspect X4, wherein the oligonucleotide comprises the sequence 5'-TCG$_1$AACG$_1$TTCG$_1$-3' (SEQ ID NO: 31) in which G$_1$ is 2'-deoxy-7-deazaguanosine, optionally wherein the oligonucleotide comprises the sequence 5'-TCG$_1$AACG$_1$TTCG$_1$-X-G$_1$CTTG$_1$CAAG$_1$CT-5' (SEQ ID NO: 32), and in which G$_1$ is 2'-deoxy-7-deazaguanosine and X is glycerol (5'-SEQ ID NO: 31-3'-X-3'-SEQ ID NO: 31-5').

X6. The composition of any one of aspects X1-5, wherein the oligonucleotide comprises at least one phosphorothioate linkage, optionally wherein all nucleotide linkages are phosphorothioate linkages.

X7. The composition of any one of aspects X1-6, wherein the oligonucleotide is a single-stranded oligodeoxynucleotide.

X8. The composition of any one of aspects X1-7, wherein a 0.5 ml dose of the immunogenic composition comprises from about 750 to about 3000 μg of the oligonucleotide, optionally wherein the immunogenic composition comprises about 750 μg, about 1500 μg, or about 3000 μg of the oligonucleotide.

X9. The composition of any one of aspects X1-8, wherein the SARS-CoV-2 antigen is an inactivated whole SARS-CoV-2.

X10. The composition of aspect X9, wherein the SARS-CoV-2 is inactivated by treatment with one or both of formalin and ultraviolet light.

X11. The composition of any one of aspects X1-8, wherein the SARS-CoV-2 antigen comprises the receptor-binding domain (RBD) of the SARS-CoV-2 spike (S) protein.

X12. The composition of aspect X11, wherein the SARS-CoV-2 antigen comprises a truncated, recombinant S protein devoid of signal peptide, transmembrane and cytoplasmic domains of a full length S protein.

X13. The composition of aspect X11 or X12, wherein the SARS-CoV-2 antigen further comprises one or more of the SARS-CoV-2 membrane (M) protein, nucleocapsid (N) protein, and envelope (E) protein.

X14. The composition of any one of aspects X1-13, further comprising an aluminum salt adjuvant.

X15. The composition of aspect X14, wherein the aluminum salt adjuvant comprises one or more of the group consisting of amorphous aluminum hydroxyphosphate sulfate, aluminum hydroxide, aluminum phosphate, and potassium aluminum sulfate X16. The composition of aspect X14, wherein the aluminum salt adjuvant comprises aluminum hydroxide.

X17. The composition of any one of aspects X14-16, wherein a 0.5 ml dose of the immunogenic composition comprises from about 0.25 to about 0.50 mg Al3+.

X18. The composition of any one of aspects X1-17, wherein the mammalian subject is a human subject.

X19. A kit comprising:
i) the immunogenic composition of any one of aspects X1-18, and
ii) instructions for administration of the composition to stimulate an immune response against the SARS-CoV-2 antigen in the mammalian subject.

X20. The kit of aspect X19, further comprising iii) a syringe and needle for intramuscular injection of the immunogenic composition.

X21. A method for stimulating an immune response against a severe acute respiratory syndrome coronavirus 2 (SARS-CoV-2) in a mammalian subject, comprising administering the immunogenic composition of any one of aspects X1-18 to a mammalian subject so as to stimulate an immune response against the SARS-CoV-2 antigen in the mammalian subject.

X22. The method of aspect X21, wherein the immunogenic composition is administered by intramuscular injection.

The present application claims priority from U.S. 62/983,737 (1 Mar. 2020), EP20168324.0 (6 Apr. 2020), EP20202124.2 (15 Oct. 2020), EP20211936.8 (4 Dec. 2020) EP21154645.2 (1 Feb. 2021), PCT/US21/20313 (1 Mar. 2021) and EP21160933.4 (5 Mar. 2021), the contents of which are incorporated herein by reference. All publications mentioned in the above specification are herein incorporated by reference. Various modifications and variations of the described embodiments of the present invention will be apparent to those skilled in the art without departing from the scope and spirit of the present invention. Although the present invention has been described in connection with specific preferred embodiments, it should be understood that the invention as claimed should not be unduly limited to such specific embodiments. Indeed, various modifications of the described modes for carrying out the invention which are obvious to those skilled in the art are intended to be within the scope of the following claims.

SEQUENCES

Severe acute respiratory syndrome coronavirus 2 (SARS-CoV-2) isolate Wuhan-Hu-1, complete genome (GenBank: MN908947; Wu, F., et al. A new coronavirus associated with human respiratory disease in China (2020) Nature 579: 265-269)

SEQ ID NO: 1

```
ATTAAAGGTTTATACCTTCCCAGGTAACAAACCAACCAACTTTCGATCTCTTGTAGATCTGTTCTCTAAACGAACTTTAAAATCTGTGTGG

CTGTCACTCGGCTGCATGCTTAGTGCACTCACGCAGTATAATTAATAACTAATTACTGTCGTTGACAGGACACGAGTAACTCGTCTATCTT

CTGCAGGCTGCTTACGGTTTCGTCCGTGTTGCAGCCGATCATCAGCACATCTAGGTTTCGTCCGGGTGTGACCGAAAGGTAAGATGGAG

AGCCTTGTCCCTGGTTTCAACGAGAAAACACACGTCCAACTCAGTTTGCCTGTTTTACAGGTTCGCGACGTGCTCGTACGTGGCTTTGGA

GACTCCGTGGAGGAGGTCTTATCAGAGGCACGTCAACATCTTAAAGATGGCACTTGTGGCTTAGTAGAAGTTGAAAAAGGCGTTTTGCC

TCAACTTGAACAGCCCTATGTGTTCATCAAACGTTCGGATGCTCGAACTGCACCTCATGGTCATGTTATGGTTGAGCTGGTAGCAGAACT

CGAAGGCATTCAGTACGGTCGTAGTGGTGAGACACTTGGTGTCCTTGTCCCTCATGTGGGCGAAATACCAGTGGCTTACCGCAAGGTTC

TTCTTCGTAAGAACGGTAATAAAGGAGCTGGTGGCCATAGTTACGGCGCCGATCTAAAGTCATTTGACTTAGGCGACGAGCTTGGCACT

GATCCTTATGAAGATTTTCAAGAAAACTGGAACACTAAACATAGCAGTGGTGTTACCCGTGAACTCATGCGTGAGCTTAACGGAGGGGC

ATACACTCGCTATGTCGATAACAACTTCTGTGGCCCTGATGGCTACCCTCTTGAGTGCATTAAAGACCTTCTAGCACGTGCTGGTAAAGC

TTCATGCACTTTGTCCGAACAACTGGACTTTATTGACACTAAGAGGGGTGTATACTGCTGCCGTGAACATGAGCATGAAATTGCTTGGTA

CACGGAACGTTCTGAAAAGAGCTATGAATTGCAGACACCTTTTGAAATTAAATTGGCAAAGAAATTTGACACCTTCAATGGGGAATGTC

CAAATTTTGTATTTCCCTTAAATTCCATAATCAAGACTATTCAACCAAGGGTTGAAAAGAAAAAGCTTGATGGCTTTATGGGTAGAATTC

GATCTGTCTATCCAGTTGCGTCACCAAATGAATGCAACCAAATGTGCCTTTCAACTCTCATGAAGTGTGATCATTGTGGTGAAACTTCATG

GCAGACGGGCGATTTTGTTAAAGCCACTTGCGAATTTTGTGGCACTGAGAATTTGACTAAAGAAGGTGCCACTACTTGTGGTTACTTACC

CCAAAATGCTGTTGTTAAAATTTATTGTCCAGCATGTCACAATTCAGAAGTAGGACCTGAGCATAGTCTTGCCGAATACCATAATGAATC

TGGCTTGAAAACCATTCTTCGTAAGGGTGGTCGCACTATTGCCTTTGGAGGCTGTGTGTTCTCTTATGTTGGTTGCCATAACAAGTGTGC

CTATTGGGTTCCACGTGCTAGCGCTAACATAGGTTGTAACCATACAGGTGTTGTTGGAGAAGGTTCCGAAGGTCTTAATGACAACCTTCT

TGAAATACTCCAAAAAGAGAAAGTCAACATCAATATTGTTGGTGACTTTAAACTTAATGAAGAGATCGCCATTATTTTGGCATCTTTTTCT

GCTTCCACAAGTGCTTTTGTGGAAACTGTGAAAGGTTTGGATTATAAAGCATTCAAACAAATTGTTGAATCCTGTGGTAATTTTAAAGTT

ACAAAAGGAAAAGCTAAAAAAGGTGCCTGGAATATTGGTGAACAGAAATCAATACTGAGTCCTCTTTATGCATTTGCATCAGAGGCTGC

TCGTGTTGTACGATCAATTTTCTCCCGCACTCTTGAAACTGCTCAAAATTCTGTGCGTGTTTTACAGAAGGCCGCTATAACAATACTAGAT

GGAATTTCACAGTATTCACTGAGACTCATTGATGCTATGATGTTCACATCTGATTTGGCTACTAACAATCTAGTTGTAATGGCCTACATTA

CAGGTGGTGTTGTTCAGTTGACTTCGCAGTGGCTAACTAACATCTTTGGCACTGTTTATGAAAAACTCAAACCCGTCCTTGATTGGCTTGA

AGAGAAGTTTAAGGAAGGTGTAGAGTTTCTTAGAGACGGTTGGGAAATTGTTAAATTTATCTCAACCTGTGCTTGTGAAATTGTCGGTG

GACAAATTGTCACCTGTGCAAAGGAAATTAAGGAGAGTGTTCAGACATTCTTTAAGCTTGTAAATAAATTTTTGGCTTTGTGTGCTGACT

CTATCATTATTGGTGGAGCTAAACTTAAAGCCTTGAATTTAGGTGAAACATTTGTCACGCACTCAAAGGGATTGTACAGAAAGTGTGTTA

AATCCAGAGAAGAAACTGGCCTACTCATGCCTCTAAAAGCCCCAAAAGAAATTATCTTCTTAGAGGGAGAAACACTTCCCACAGAAGTG

TTAACAGAGGAAGTTGTCTTGAAAACTGGTGATTTACAACCATTAGAACAACCTACTAGTGAAGCTGTTGAAGCTCCATTGGTTGGTACA

CCAGTTTGTATTAACGGGCTTATGTTGCTCGAAATCAAAGACACAGAAAAGTACTGTGCCCTTGCACCTAATATGATGGTAACAAACAAT
```

```
ACCTTCACACTCAAAGGCGGTGCACCAACAAAGGTTACTTTTGGTGATGACACTGTGATAGAAGTGCAAGGTTACAAGAGTGTGAATAT
CACTTTTGAACTTGATGAAAGGATTGATAAAGTACTTAATGAGAAGTGCTCTGCCTATACAGTTGAACTCGGTACAGAAGTAAATGAGTT
CGCCTGTGTTGTGGCAGATGCTGTCATAAAAACTTTGCAACCAGTATCTGAATTACTTACACCACTGGGCATTGATTTAGATGAGTGGAG
TATGGCTACATACTACTTATTTGATGAGTCTGGTGAGTTTAAATTGGCTTCACATATGTATTGTTCTTTCTACCCTCCAGATGAGGATGAA
GAAGAAGGTGATTGTGAAGAAGAAGAGTTTGAGCCATCAACTCAATATGAGTATGGTACTGAAGATGATTACCAAGGTAAACCTTTGG
AATTTGGTGCCACTTCTGCTGCTCTTCAACCTGAAGAAGAGCAAGAAGAAGATTGGTTAGATGATGATAGTCAACAAACTGTTGGTCAA
CAAGACGGCAGTGAGGACAATCAGACAACTACTATTCAAACAATTGTTGAGGTTCAACCTCAATTAGAGATGGAACTTACACCAGTTGT
TCAGACTATTGAAGTGAATAGTTTTAGTGGTTATTTAAAACTTACTGACAATGTATACATTAAAAATGCAGACATTGTGGAAGAAGCTAA
AAAGGTAAAACCAACAGTGGTTGTTAATGCAGCCAATGTTTACCTTAAACATGGAGGAGGTGTTGCAGGAGCCTTAAATAAGGCTACTA
ACAATGCCATGCAAGTTGAATCTGATGATTACATAGCTACTAATGGACCACTTAAAGTGGGTGGTAGTTGTGTTTTAAGCGGACACAATC
TTGCTAAACACTGTCTTCATGTTGTCGGCCCAAATGTTAACAAAGGTGAAGACATTCAACTTCTTAAGAGTGCTTATGAAAATTTTAATCA
GCACGAAGTTCTACTTGCACCATTATTATCAGCTGGTATTTTTGGTGCTGACCCTATACATTCTTTAAGAGTTTGTGTAGATACTGTTCGCA
CAAATGTCTACTTAGCTGTCTTTGATAAAAATCTCTATGACAAACTTGTTTCAAGCTTTTTGGAAATGAAGAGTGAAAAGCAAGTTGAAC
AAAAGATCGCTGAGATTCCTAAAGAGGAAGTTAAGCCATTTATAACTGAAAGTAAACCTTCAGTTGAACAGAGAAAACAAGATGATAAG
AAAATCAAAGCTTGTGTTGAAGAAGTTACAACAACTCTGGAAGAAACTAAGTTCCTCACAGAAAACTTGTTACTTTATATTGACATTAAT
GGCAATCTTCATCCAGATTCTGCCACTCTTGTTAGTGACATTGACATCACTTTCTTAAAGAAAGATGCTCCATATATAGTGGGTGATGTTG
TTCAAGAGGGTGTTTTAACTGCTGTGGTTATACCTACTAAAAAGGCTGGTGGCACTACTGAAATGCTAGCGAAAGCTTTGAGAAAAGTG
CCAACAGACAATTATATAACCACTTACCCGGGTCAGGGTTTAAATGGTTACACTGTAGAGGAGGCAAAGACAGTGCTTAAAAAGTGTAA
AAGTGCCTTTTACATTCTACCATCTATTATCTCTAATGAGAAGCAAGAAATTCTTGGAACTGTTTCTTGGAATTTGCGAGAAATGCTTGCA
CATGCAGAAGAAACACGCAAATTAATGCCTGTCTGTGTGGAAACTAAAGCCATAGTTTCAACTATACAGCGTAAATATAAGGGTATTAA
AATACAAGAGGGTGTGGTTGATTATGGTGCTAGATTTTACTTTTACACCAGTAAAACAACTGTAGCGTCACTTATCAACACACTTAACGA
TCTAAATGAAACTCTTGTTACAATGCCACTTGGCTATGTAACACATGGCTTAAATTTGGAAGAAGCTGCTCGGTATATGAGATCTCTCAA
AGTGCCAGCTACAGTTTCTGTTTCTTCACCTGATGCTGTTACAGCGTATAATGGTTATCTTACTTCTTCTTCTAAAACACCTGAAGAACATT
TTATTGAAACCATCTCACTTGCTGGTTCCTATAAAGATTGGTCCTATTCTGGACAATCTACACAACTAGGTATAGAATTTCTTAAGAGAGG
TGATAAAAGTGTATATTACACTAGTAATCCTACCACATTCCACCTAGATGGTGAAGTTATCACCTTTGACAATCTTAAGACACTTCTTTCTT
TGAGAGAAGTGAGGACTATTAAGGTGTTTACAACAGTAGACAACATTAACCTCCACACGCAAGTTGTGGACATGTCAATGACATATGGA
CAACAGTTTGGTCCAACTTATTTGGATGGAGCTGATGTTACTAAAATAAAACCTCATAATTCACATGAAGGTAAAACATTTTATGTTTTAC
CTAATGATGACACTCTACGTGTTGAGGCTTTTGAGTACTACCACACAACTGATCCTAGTTTTCTGGGTAGGTACATGTCAGCATTAAATCA
CACTAAAAAGTGGAAATACCCACAAGTTAATGGTTTAACTTCTATTAAATGGGCAGATAACAACTGTTATCTTGCCACTGCATTGTTAACA
CTCCAACAAATAGAGTTGAAGTTTAATCCACCTGCTCTACAAGATGCTTATTACAGAGCAAGGGCTGGTGAAGCTGCTAACTTTTGTGCA
CTTATCTTAGCCTACTGTAATAAGACAGTAGGTGAGTTAGGTGATGTTAGAGAAACAATGAGTTACTTGTTTCAACATGCCAATTTAGAT
TCTTGCAAAAGAGTCTTGAACGTGGTGTGTAAAACTTGTGGACAACAGCAGACAACCCTTAAGGGTGTAGAAGCTGTTATGTACATGGG
CACACTTTCTTATGAACAATTTAAGAAAGGTGTTCAGATACCTTGTACGTGTGGTAAACAAGCTACAAAATATCTAGTACAACAGGAGTC
ACCTTTTGTTATGATGTCAGCACCACCTGCTCAGTATGAACTTAAGCATGGTACATTTACTTGTGCTAGTGAGTACACTGGTAATTACCAG
TGTGGTCACTATAAACATATAACTTCTAAAGAAACTTTGTATTGCATAGACGGTGCTTTACTTACAAAGTCCTCAGAATACAAAGGTCCTA
TTACGGATGTTTTCTACAAAGAAAACAGTTACAACAACCATAAAACCAGTTACTTATAAATTGGATGGTGTTGTTTGTACAGAAATTG
ACCCTAAGTTGGACAATTATTATAAGAAAGACAATTCTTATTTCACAGAGCAACCAATTGATCTTGTACCAAACCAACCATATCCAAACGC
AAGCTTCGATAATTTTAAGTTTGTATGTGATAATATCAAATTTGCTGATGATTTAAACCAGTTAACTGGTTATAAGAAACCTGCTTCAAGA
```

| SEQUENCES |
|---|
| GAGCTTAAAGTTACATTTTTCCCTGACTTAAATGGTGATGTGGTGGCTATTGATTATAAACACTACACACCCTCTTTTAAGAAAGGAGCTA |
| AATTGTTACATAAACCTATTGTTTGGCATGTTAACAATGCAACTAATAAAGCCACGTATAAACCAAATACCTGGTGTATACGTTGTCTTTG |
| GAGCACAAAACCAGTTGAAACATCAAATTCGTTTGATGTACTGAAGTCAGAGGACGCGCAGGGAATGGATAATCTTGCCTGCGAAGAT |
| CTAAAACCAGTCTCTGAAGAAGTAGTGGAAAATCCTACCATACAGAAAGACGTTCTTGAGTGTAATGTGAAAACTACCGAAGTTGTAGG |
| AGACATTATACTTAAACCAGCAAATAATAGTTTAAAAATTACAGAAGAGGTTGGCCACACAGATCTAATGGCTGCTTATGTAGACAATTC |
| TAGTCTTACTATTAAGAAACCTAATGAATTATCTAGAGTATTAGGTTTGAAAACCCTTGCTACTCATGGTTTAGCTGCTGTTAATAGTGTC |
| CCTTGGGATACTATAGCTAATTATGCTAAGCCTTTTCTTAACAAAGTTGTTAGTACAACTACTAACATAGTTACACGGTGTTTAAACCGTG |
| TTTGTACTAATTATATGCCTTATTTCTTTACTTTATTGCTACAATTGTGTACTTTTACTAGAAGTACAAATTCTAGAATTAAAGCATCTATGC |
| CGACTACTATAGCAAAGAATACTGTTAAGAGTGTCGGTAAATTTTGTCTAGAGGCTTCATTTAATTATTTGAAGTCACCTAATTTTTCTAA |
| ACTGATAAATATTATAATTTGGTTTTTACTATTAAGTGTTTGCCTAGGTTCTTTAATCTACTCAACCGCTGCTTTAGGTGTTTTAATGTCTAA |
| TTTAGGCATGCCTTCTTACTGTACTGGTTACAGAGAAGGCTATTTGAACTCTACTAATGTCACTATTGCAACCTACTGTACTGGTTCTATAC |
| CTTGTAGTGTTTGTCTTAGTGGTTTAGATTCTTTAGACACCTATCCTTCTTTAGAAACTATACAAATTACCATTTCATCTTTTAAATGGGATT |
| TAACTGCTTTTGGCTTAGTTGCAGAGTGGTTTTTGGCATATATTCTTTTCACTAGGTTTTTCTATGTACTTGGATTGGCTGCAATCATGCAA |
| TTGTTTTTCAGCTATTTTGCAGTACATTTTATTAGTAATTCTTGGCTTATGTGGTTAATAATTAATCTTGTACAAATGGCCCCGATTTCAGCT |
| ATGGTTAGAATGTACATCTTCTTTGCATCATTTTATTATGTATGGAAAAGTTATGTGCATGTTGTAGACGGTTGTAATTCATCAACTTGTAT |
| GATGTGTTACAAACGTAATAGAGCAACAAGAGTCGAATGTACAACTATTGTTAATGGTGTTAGAAGGTCCTTTTATGTCTATGCTAATGG |
| AGGTAAAGGCTTTTGCAAACTACACAATTGGAATTGTGTTAATTGTGATACATTCTGTGCTGGTAGTACATTTATTAGTGATGAAGTTGC |
| GAGAGACTTGTCACTACAGTTTAAAAGACCAATAAATCCTACTGACCAGTCTTCTTACATCGTTGATAGTGTTACAGTGAAGAATGGTTC |
| CATCCATCTTTACTTTGATAAAGCTGGTCAAAAGACTTATGAAAGACATTCTCTCTCTCATTTTGTTAACTTAGACAACCTGAGAGCTAAT |
| AACACTAAAGGTTCATTGCCTATTAATGTTATAGTTTTTGATGGTAAATCAAAATGTGAAGAATCATCTGCAAAATCAGCGTCTGTTTACT |
| ACAGTCAGCTTATGTGTCAACCTATACTGTTACTAGATCAGGCATTAGTGTCTGATGTTGGTGATAGTGCGGAAGTTGCAGTTAAAATGT |
| TTGATGCTTACGTTAATACGTTTTCATCAACTTTTAACGTACCAATGGAAAAACTCAAAACACTAGTTGCAACTGCAGAAGCTGAACTTGC |
| AAAGAATGTGTCCTTAGACAATGTCTTATCTACTTTTATTTCAGCAGCTCGGCAAGGGTTTGTTGATTCAGATGTAGAAACTAAAGATGTT |
| GTTGAATGTCTTAAATTGTCACATCAATCTGACATAGAAGTTACTGGCGATAGTTGTAATAACTATATGCTCACCTATAACAAAGTTGAAA |
| ACATGACACCCCGTGACCTTGGTGCTTGTATTGACTGTAGTGCGCGTCATATTAATGCGCAGGTAGCAAAAAGTCACAACATTGCTTTGA |
| TATGGAACGTTAAAGATTTCATGTCATTGTCTGAACAACTACGAAAACAAATACGTAGTGCTGCTAAAAAGAATAACTTACCTTTTAAGT |
| TGACATGTGCAACTACTAGACAAGTTGTTAATGTTGTAACAACAAAGATAGCACTTAAGGGTGGTAAAATTGTTAATAATTGGTTGAAG |
| CAGTTAATTAAAGTTACACTTGTGTTCCTTTTTGTTGCTGCTATTTTCTATTTAATAACACCTGTTCATGTCATGTCTAAACATACTGACTTT |
| TCAAGTGAAATCATAGGATACAAGGCTATTGATGGTGGTGTCACTCGTGACATAGCATCTACAGATACTTGTTTTGCTAACAAACATGCT |
| GATTTTGACACATGGTTTAGCCAGCGTGGTGGTAGTTATACTAATGACAAAGCTTGCCCATTGATTGCTGCAGTCATAACAAGAGAAGT |
| GGGTTTTGTCGTGCCTGGTTTGCCTGGCACGATATTACGCACAACTAATGGTGACTTTTGCATTTCTTACCTAGAGTTTTTAGTGCAGTT |
| GGTAACATCTGTTACACACCATCAAAACTTATAGAGTACACTGACTTTGCAACATCAGCTTGTGTTTTGGCTGCTGAATGTACAATTTTA |
| AAGATGCTTCTGGTAAGCCAGTACCATATTGTTATGATACCAATGTACTAGAAGGTTCTGTTGCTTATGAAAGTTTACGCCCTGACACAC |
| GTTATGTGCTCATGGATGGCTCTATTATTCAATTTCCTAACACCTACCTTGAAGGTTCTGTTAGAGTGGTAACAACTTTTGATTCTGAGTA |
| CTGTAGGCACGGCACTTGTGAAAGATCAGAAGCTGGTGTTTGTATCTACTAGTGGTAGATGGGTACTTAACAATGATTATTACAGAT |
| CTTTACCAGGAGTTTTCTGTGGTGTAGATGCTGTAAATTTACTTACTAATATGTTTACACCACTAATTCAACCTATTGGTGCTTTGGACATA |
| TCAGCATCTATAGTAGCTGGTGGTATTGTAGCTATCGTAGTAACATGCCTTGCCTACTATTTTATGAGGTTTAGAAGAGCTTTTGGTGAAT |
| ACAGTCATGTAGTTGCCTTTAATACTTTACTATTCCTTATGTCATTCACTGTACTCTGTTTAACACCAGTTTACTCATTCTTACCTGGTGTTT |
| ATTCTGTTATTTACTTGTACTTGACATTTTATCTTACTAATGATGTTTCTTTTTAGCACATATTCAGTGGATGGTTATGTTCACACCTTTAG |

```
TACCTTTCTGGATAACAATTGCTTATATCATTTGTATTTCCACAAAGCATTTCTATTGGTTCTTTAGTAATTACCTAAAGAGACGTGTAGTC

TTTAATGGTGTTTCCTTTAGTACTTTTGAAGAAGCTGCGCTGTGCACCTTTTTGTTAAATAAAGAAATGTATCTAAAGTTGCGTAGTGATG

TGCTATTACCTCTTACGCAATATAATAGATACTTAGCTCTTTATAATAAGTACAAGTATTTTAGTGGAGCAATGGATACAACTAGCTACAG

AGAAGCTGCTTGTTGTCATCTCGCAAAGGCTCTCAATGACTTCAGTAACTCAGGTTCTGATGTTCTTTACCAACCACCACAAACCTCTATC

ACCTCAGCTGTTTTGCAGAGTGGTTTTAGAAAAATGGCATTCCCATCTGGTAAAGTTGAGGGTTGTATGGTACAAGTAACTTGTGGTACA

ACTACACTTAACGGTCTTTGGCTTGATGACGTAGTTTACTGTCCAAGACATGTGATCTGCACCTCTGAAGACATGCTTAACCCTAATTATG

AAGATTTACTCATTCGTAAGTCTAATCATAATTTCTTGGTACAGGCTGGTAATGTTCAACTCAGGGTTATTGGACATTCTATGCAAAATTG

TGTACTTAAGCTTAAGGTTGATACAGCCAATCCTAAGACACCTAAGTATAAGTTTGTTCGCATTCAACCAGGACAGACTTTTTCAGTGTTA

GCTTGTTACAATGGTTCACCATCTGGTGTTTACCAATGTGCTATGAGGCCCAATTTCACTATTAAGGGTTCATTCCTTAATGGTTCATGTG

GTAGTGTTGGTTTTAACATAGATTATGACTGTGTCTCTTTTTGTTACATGCACCATATGGAATTACCAACTGGAGTTCATGCTGGCACAGA

CTTAGAAGGTAACTTTTATGGACCTTTTGTTGACAGGCAAACAGCACAAGCAGCTGGTACGGACACAACTATTACAGTTAATGTTTTAGC

TTGGTTGTACGCTGCTGTTATAAATGGAGACAGGTGGTTTCTCAATCGATTTACCACAACTCTTAATGACTTTAACCTTGTGGCTATGAAG

TACAATTATGAACCTCTAACACAAGACCATGTTGACATACTAGGACCTCTTTCTGCTCAAACTGGAATTGCCGTTTTAGATATGTGTGCTT

CATTAAAAGAATTACTGCAAAATGGTATGAATGGACGTACCATATTGGGTAGTGCTTTATTAGAAGATGAATTTACACCTTTTGATGTTG

TTAGACAATGCTCAGGTGTTACTTTCCAAAGTGCAGTGAAAAGAACAATCAAGGGTACACACCACTGGTTGTTACTCACAATTTTGACTT

CACTTTTAGTTTTAGTCCAGAGTACTCAATGGTCTTTGTTCTTTTTTTGTATGAAAATGCCTTTTTACCTTTTGCTATGGGTATTATTGCTA

TGTCTGCTTTTGCAATGATGTTTGTCAAACATAAGCATGCATTTCTCTGTTTGTTTTTGTTACCTTCTCTTGCCACTGTAGCTTATTTTAATA

TGGTCTATATGCCTGCTAGTTGGGTGATGCGTATTATGACATGGTTGGATATGGTTGATACTAGTTTGTCTGGTTTTAAGCTAAAAGACT

GTGTTATGTATGCATCAGCTGTAGTGTTACTAATCCTTATGACAGCAAGAACTGTGTATGATGATGGTGCTAGGAGAGTGTGGACACTT

ATGAATGTCTTGACACTCGTTTATAAAGTTTATTATGGTAATGCTTTAGATCAAGCCATTTCCATGTGGGCTCTTATAATCTCTGTTACTTC

TAACTACTCAGGTGTAGTTACAACTGTCATGTTTTTGGCCAGAGGTATTGTTTTATGTGTGTTGAGTATTGCCCTATTTTCTTCATAACTG

GTAATACACTTCAGTGTATAATGCTAGTTTATTGTTTCTTAGGCTATTTTTGTACTTGTTACTTTGGCCTCTTTTGTTTACTCAACCGCTACT

TTAGACTGACTCTTGGTGTTTATGATTACTTAGTTTCTACACAGGAGTTTAGATATATGAATTCACAGGGACTACTCCCACCCAAGAATAG

CATAGATGCCTTCAAACTCAACATTAAATTGTTGGGTGTTGGTGGCAAACCTTGTATCAAAGTAGCCACTGTACAGTCTAAAATGTCAGA

TGTAAAGTGCACATCAGTAGTCTTACTCTCAGTTTTGCAACAACTCAGAGTAGAATCATCATCTAAATTGTGGGCTCAATGTGTCCAGTTA

CACAATGACATTCTCTTAGCTAAAGATACTACTGAAGCCTTTGAAAAAATGGTTTCACTACTTTCTGTTTTGCTTTCCATGCAGGGTGCTG

TAGACATAAACAAGCTTTGTGAAGAAATGCTGGACAACAGGGCAACCTTACAAGCTATAGCCTCAGAGTTTAGTTCCCTTCCATCATATG

CAGCTTTTGCTACTGCTCAAGAAGCTTATGAGCAGGCTGTTGCTAATGGTGATTCTGAAGTTGTTCTTAAAAAGTTGAAGAAGTCTTTGA

ATGTGGCTAAATCTGAATTTGACCGTGATGCAGCCATGCAACGTAAGTTGGAAAAGATGGCTGATCAAGCTATGACCCAAATGTATAAA

CAGGCTAGATCTGAGGACAAGAGGGCAAAAGTTACTAGTGCTATGCAGACAATGCTTTTCACTATGCTTAGAAAGTTGGATAATGATGC

ACTCAACAACATTATCAACAATGCAAGAGATGGTTGTGTTCCCTTGAACATAATACCTCTTACAACAGCAGCCAAACTAATGGTTGTCAT

ACCAGACTATAACACATATAAAAATACGTGTGATGGTACAACATTTACTTATGCATCAGCATTGTGGGAAATCCAACAGGTTGTAGATGC

AGATAGTAAAATTGTTCAACTTAGTGAAATTAGTATGGACAATTCACCTAATTTAGCATGGCCTCTTATTGTAACAGCTTTAAGGGCCAAT

TCTGCTGTCAAATTACAGAATAATGAGCTTAGTCCTGTTGCACTACGACAGATGTCTTGTGCTGCCGGTACTACACAAACTGCTTGCACT

GATGACAATGCGTTAGCTTACTACAACACAACAAAGGGAGGTAGGTTTGTACTTGCACTGTTATCCGATTTACAGGATTTGAAATGGGC

TAGATTCCCTAAGAGTGATGGAACTGGTACTATCTATACAGAACTGGAACCACCTTGTAGGTTTGTTACAGACACACCTAAAGGTCCTAA

AGTGAAGTATTTATACTTTATTAAAGGATTAAACAACCTAAATAGAGGTATGGTACTTGGTAGTTTAGCTGCCACAGTACGTCTACAAGC

TGGTAATGCAACAGAAGTGCCTGCCAATTCAACTGTATTATCTTTCTGTGCTTTTGCTGTAGATGCTGCTAAAGCTTACAAAGATTATCTA
```

| SEQUENCES |
|---|
| GCTAGTGGGGGACAACCAATCACTAATTGTGTTAAGATGTTGTGTACACACACTGGTACTGGTCAGGCAATAACAGTTACACCGGAAGC |
| CAATATGGATCAAGAATCCTTTGGTGGTGCATCGTGTTGTCTGTACTGCCGTTGCCACATAGATCATCCAAATCCTAAAGGATTTTGTGA |
| CTTAAAAGGTAAGTATGTACAAATACCTACAACTTGTGCTAATGACCCTGTGGGTTTTACACTTAAAAACACAGTCTGTACCGTCTGCGG |
| TATGTGGAAAGGTTATGGCTGTAGTTGTGATCAACTCCGCGAACCCATGCTTCAGTCAGCTGATGCACAATCGTTTTTAAACGGGTTTGC |
| GGTGTAAGTGCAGCCCGTCTTACACCGTGCGGCACAGGCACTAGTACTGATGTCGTATACAGGGCTTTTGACATCTACAATGATAAAGT |
| AGCTGGTTTTGCTAAATTCCTAAAAACTAATTGTTGTCGCTTCCAAGAAAAGGACGAAGATGACAATTTAATTGATTCTTACTTTGTAGTT |
| AAGAGACACACTTTCTCTAACTACCAACATGAAGAAACAATTTATAATTTACTTAAGGATTGTCCAGCTGTTGCTAAACATGACTTCTTTA |
| AGTTTAGAATAGACGGTGACATGGTACCACATATATCACGTCAACGTCTTACTAAATACACAATGGCAGACCTCGTCTATGCTTTAAGGC |
| ATTTTGATGAAGGTAATTGTGACACATTAAAAGAAATACTTGTCACATACAATTGTTGTGATGATGATTATTTCAATAAAAAGGACTGGT |
| ATGATTTTGTAGAAAACCCAGATATATTACGCGTATACGCCAACTTAGGTGAACGTGTACGCCAAGCTTTGTTAAAAACAGTACAATTCT |
| GTGATGCCATGCGAAATGCTGGTATTGTTGGTGTACTGACATTAGATAATCAAGATCTCAATGGTAACTGGTATGATTTCGGTGATTTCA |
| TACAAACCACGCCAGGTAGTGGAGTTCCTGTTGTAGATTCTTATTATTCATTGTTAATGCCTATATTAACCTTGACCAGGGCTTTAACTGC |
| AGAGTCACATGTTGACACTGACTTAACAAAGCCTTACATTAAGTGGGATTTGTTAAAATATGACTTCACGGAAGAGAGGTTAAAACTCTT |
| TGACCGTTATTTTAAATATTGGGATCAGACATACCACCCAAATTGTGTTAACTGTTTGGATGACAGATGCATTCTGCATTGTGCAAACTTT |
| AATGTTTTATTCTCTACAGTGTTCCCACCTACAAGTTTTGGACCACTAGTGAGAAAAATATTTGTTGATGGTGTTCCATTTGTAGTTTCAAC |
| TGGATACCACTTCAGAGAGCTAGGTGTTGTACATAATCAGGATGTAAACTTACATAGCTCTAGACTTAGTTTTAAGGAATTACTTGTGTA |
| TGCTGCTGACCCTGCTATGCACGCTGCTTCTGGTAATCTATTACTAGATAAACGCACTACGTGCTTTTCAGTAGCTGCACTTACTAACAAT |
| GTTGCTTTTCAAACTGTCAAACCCGGTAATTTTAACAAAGACTTCTATGACTTTGCTGTGTCTAAGGGTTTCTTTAAGGAAGGAAGTTCTG |
| TTGAATTAAAACACTTCTTCTTTGCTCAGGATGGTAATGCTGCTATCAGCGATTATGACTACTATCGTTATAATCTACCAACAATGTGTGA |
| TATCAGACAACTACTATTTGTAGTTGAAGTTGTTGATAAGTACTTTGATTGTTACGATGGTGGCTGTATTAATGCTAACCAAGTCATCGTC |
| AACAACCTAGACAAATCAGCTGGTTTTCCATTTAATAAATGGGGTAAGGCTAGACTTTATTATGATTCAATGAGTTATGAGGATCAAGAT |
| GCACTTTTCGCATATACAAAACGTAATGTCATCCCTACTATAACTCAAATGAATCTTAAGTATGCCATTAGTGCAAAGAATAGAGCTCGCA |
| CCGTAGCTGGTGTCTCTATCTGTAGTACTATGACCAATAGACAGTTTCATCAAAAATTATTGAAATCAATAGCCGCCACTAGAGGAGCTA |
| CTGTAGTAATTGGAACAAGCAAATTCTATGGTGGTTGGCACAACATGTTAAAAACTGTTTATAGTGATGTAGAAAACCCTCACCTTATGG |
| GTTGGGATTATCCTAAATGTGATAGAGCCATGCCTAACATGCTTAGAATTATGGCCTCACTTGTTCTTGCTCGCAAACATACAACGTGTTG |
| TAGCTTGTCACACCGTTTCTATAGATTAGCTAATGAGTGTGCTCAAGTATTGAGTGAAATGGTCATGTGTGGCGGTTCACTATATGTTAA |
| ACCAGGTGGAACCTCATCAGGAGATGCCACAACTGCTTATGCTAATAGTGTTTTTAACATTTGTCAAGCTGTCACGGCCAATGTTAATGC |
| ACTTTTATCTACTGATGGTAACAAAATTGCCGATAAGTATGTCCGCAATTTACAACACAGACTTTATGAGTGTCTCTATAGAAATAGAGAT |
| GTTGACACAGACTTTGTGAATGAGTTTTACGCATATTTGCGTAAACATTTCTCAATGATGATACTCTCTGACGATGCTGTTGTGTTTCA |
| ATAGCACTTATGCATCTCAAGGTCTAGTGGCTAGCATAAAGAACTTTAAGTCAGTTCTTTATTATCAAAACAATGTTTTTATGTCTGAAGC |
| AAAATGTTGGACTGAGACTGACCTTACTAAAGGACCTCATGAATTTTGCTCTCAACATACAATGCTAGTTAAACAGGGTGATGATTATGT |
| GTACCTTCCTTACCCAGATCCATCAAGAATCCTAGGGGCCGGCTGTTTTGTAGATGATATCGTAAAAACAGATGGTACACTTATGATTGA |
| ACGGTTCGTGTCTTTAGCTATAGATGCTTACCCACTTACTAAACATCCTAATCAGGAGTATGCTGATGTCTTTCATTTGTACTTACAATACA |
| TAAGAAAGCTACATGATGAGTTAACAGGACACATGTTAGACATGTATTCTGTTATGCTTACTAATGATAACACTTCAAGGTATTGGGAAC |
| CTGAGTTTTATGAGGCTATGTACACACCGCATACAGTCTTACAGGCTGTTGGGCTTGTGTTCTTTGCAATTCACAGACTTCATTAAGATG |
| TGGTGCTTGCATACGTAGACCATTCTTATGTTGTAAATGCTGTTACGACCATGTCATATCAACATCACATAAATTAGTCTTGTCTGTTAATC |
| CGTATGTTTGCAATGCTCCAGGTTGTGATGTCACAGATGTGACTCAACTTTACTTAGGAGGTATGAGCTATTATTGTAAATCACATAAAC |
| CACCCATTAGTTTTCCATTGTGTGCTAATGGACAAGTTTTTGGTTTATATAAAAATACATGTGTTGGTAGCGATAATGTTACTGACTTTAA |
| TGCAATTGCAACATGTGACTGGACAAATGCTGGTGATTACATTTTAGCTAACACCTGTACTGAAAGACTCAAGCTTTTTGCAGCAGAAAC |

-continued

SEQUENCES

```
GCTCAAAGCTACTGAGGAGACATTTAAACTGTCTTATGGTATTGCTACTGTACGTGAAGTGCTGTCTGACAGAGAATTACATCTTTCATG
GGAAGTTGGTAAACCTAGACCACCACTTAACCGAAATTATGTCTTTACTGGTTATCGTGTAACTAAAAACAGTAAAGTACAAATAGGAG
AGTACACCTTTGAAAAAGGTGACTATGGTGATGCTGTTGTTTACCGAGGTACAACAACTTACAAATTAAATGTTGGTGATTATTTTGTGC
TGACATCACATACAGTAATGCCATTAAGTGCACCTACACTAGTGCCACAAGAGCACTATGTTAGAATTACTGGCTTATACCCAACACTCA
ATATCTCAGATGAGTTTTCTAGCAATGTTGCAAATTATCAAAAGGTTGGTATGCAAAAGTATTCTACACTCCAGGGACCACCTGGTACTG
GTAAGAGTCATTTTGCTATTGGCCTAGCTCTCTACTACCCTTCTGCTCGCATAGTGTATACAGCTTGCTCTCATGCCGCTGTTGATGCACTA
TGTGAGAAGGCATTAAAATATTTGCCTATAGATAAATGTAGTAGAATTATACCTGCACGTGCTCGTGTAGAGTGTTTTGATAAATTCAAA
GTGAATTCAACATTAGAACAGTATGTCTTTTGTACTGTAAATGCATTGCCTGAGACGACAGCAGATATAGTTGTCTTTGATGAAATTTCA
ATGGCCACAAATTATGATTTGAGTGTTGTCAATGCCAGATTACGTGCTAAGCACTATGTGTACATTGGCGACCCTGCTCAATTACCTGCA
CCACGCACATTGCTAACTAAGGGCACACTAGAACCAGAATATTTCAATTCAGTGTGTAGACTTATGAAAACTATAGGTCCAGACATGTTC
CTCGGAACTTGTCGGCGTTGTCCTGCTGAAATTGTTGACACTGTGAGTGCTTTGGTTTATGATAATAAGCTTAAAGCACATAAAGACAAA
TCAGCTCAATGCTTTAAAATGTTTTATAAGGGTGTTATCACGCATGATGTTTCATCTGCAATTAACAGGCCACAAATAGGCGTGGTAAGA
GAATTCCTTACACGTAACCCTGCTTGGAGAAAAGCTGTCTTTATTTCACCTTATAATTCACAGAATGCTGTAGCCTCAAAGATTTTGGGAC
TACCAACTCAAACTGTTGATTCATCACAGGGCTCAGAATATGACTATGTCATATTCACTCAAACCACTGAAACAGCTCACTCTTGTAATGT
AAACAGATTTAATGTTGCTATTACCAGAGCAAAAGTAGGCATACTTTGCATAATGTCTGATAGAGACCTTTATGACAAGTTGCAATTTAC
AAGTCTTGAAATTCCACGTAGGAATGTGGCAACTTTACAAGCTGAAAATGTAACAGGACTCTTTAAAGATTGTAGTAAGGTAATCACTG
GGTTACATCCTACACAGGCACCTACACACCTCAGTGTTGACACTAAATTCAAAACTGAAGGTTTATGTGTTGACATACCTGGCATACCTA
AGGACATGACCTATAGAAGACTCATCTCTATGATGGGTTTTAAAATGAATTATCAAGTTAATGGTTACCCTAACATGTTTATCACCCGCG
AAGAAGCTATAAGACATGTACGTGCATGGATTGGCTTCGATGTCGAGGGGTGTCATGCTACTAGAGAAGCTGTTGGTACCAATTTACCT
TTACAGCTAGGTTTTTCTACAGGTGTTAACCTAGTTGCTGTACCTACAGGTTATGTTGATACACCTAATAATACAGATTTTTCCAGAGTTA
GTGCTAAACCACCGCCTGGAGATCAATTTAAACACCTCATACCACTTATGTACAAAGGACTTCCTTGGAATGTAGTGCGTATAAAGATTG
TACAAATGTTAAGTGACACACTTAAAAATCTCTCTGACAGAGTCGTATTTGTCTTATGGGCACATGGCTTTGAGTTGACATCTATGAAGT
ATTTTGTGAAAATAGGACCTGAGCGCACCTGTTGTCTATGTGATAGACGTGCCACATGCTTTTCCACTGCTTCAGACACTTATGCCTGTTG
GCATCATTCTATTGGATTTGATTACGTCTATAATCCGTTTATGATTGATGTTCAACAATGGGGTTTTACAGGTAACCTACAAAGCAACCAT
GATCTGTATTGTCAAGTCCATGGTAATGCACATGTAGCTAGTTGTGATGCAATCATGACTAGGTGTCTAGCTGTCCACGAGTGCTTTGTT
AAGCGTGTTGACTGGACTATTGAATATCCTATAATTGGTGATGAACTGAAGATTAATGCGGCTTGTAGAAAGGTTCAACACATGGTTGTT
AAAGCTGCATTATTAGCAGACAAATTCCCAGTTCTTCACGACATTGGTAACCCTAAAGCTATTAAGTGTGTACCTCAAGCTGATGTAGAA
TGGAAGTTCTATGATGCACAGCCTTGTAGTGACAAAGCTTATAAAATAGAAGAATTATTCTATTCTTATGCCACACATTCTGACAAATTCA
CAGATGGTGTATGCCTATTTTGGAATTGCAATGTCGATAGATATCCTGCTAATTCCATTGTTTGTAGATTTGACACTAGAGTGCTATCTAA
CCTTAACTTGCCTGGTTGTGATGGTGGCAGTTTGTATGTAAATAAACATGCATTCCACACACCAGCTTTTGATAAAAGTGCTTTTGTTAAT
TTAAAACAATTACCATTTTTCTATTACTCTGACAGTCCATGTGAGTCTCATGGAAAACAAGTAGTGTCAGATATAGATTATGTACCACTAA
AGTCTGCTACGTGTATAACACGTTGCAATTTAGGTGGTGCTGTCTGTAGACATCATGCTAATGAGTACAGATTGTATCTCGATGCTTATA
ACATGATGATCTCAGCTGGCTTTAGCTTGTGGGTTTACAAACAATTTGATACTTATAACCTCTGGAACACTTTTACAAGACTTCAGAGTTT
AGAAAATGTGGCTTTTAATGTTGTAAATAAGGGACACTTTGATGGACAACAGGGTGAAGTACCAGTTTCTATCATTAATAACACTGTTTA
CACAAAAGTTGATGGTGTTGATGTAGAATTGTTTGAAAATAAAACAACATTACCTGTTAATGTAGCATTTGAGCTTTGGGCTAAGCGCAA
CATTAAACCAGTACCAGAGGTGAAAATACTCAATAATTTGGGTGTGGACATTGCTGCTAATACTGTGATCTGGGACTACAAAAGAGATG
CTCCAGCACATATATCTACTATTGGTGTTTGTTCTATGACTGACATAGCCAAGAAACCAACTGAAACGATTTGTGCACCACTCACTGTCTT
TTTTGATGGTAGAGTTGATGGTCAAGTAGACTTATTTAGAAATGCCCGTAATGGTGTTCTTATTACAGAAGGTAGTGTTAAAGGTTTACA
```

| SEQUENCES |
|---|
| ACCATCTGTAGGTCCCAAACAAGCTAGTCTTAATGGAGTCACATTAATTGGAGAAGCCGTAAAAACACAGTTCAATTATTATAAGAAAGT |
| TGATGGTGTTGTCCAACAATTACCTGAAACTTACTTTACTCAGAGTAGAAATTTACAAGAATTTAAACCCAGGAGTCAAATGGAAATTGA |
| TTTCTTAGAATTAGCTATGGATGAATTCATTGAACGGTATAAATTAGAAGGCTATGCCTTCGAACATATCGTTTATGGAGATTTTAGTCAT |
| AGTCAGTTAGGTGGTTTACATCTACTGATTGGACTAGCTAAACGTTTTAAGGAATCACCTTTTGAATTAGAAGATTTTATTCCTATGGACA |
| GTACAGTTAAAAACTATTTCATAACAGATGCGCAAACAGGTTCATCTAAGTGTGTGTGTTCTGTTATTGATTATTACTTGATGATTTTGTT |
| GAAATAATAAAATCCCAAGATTTATCTGTAGTTTCTAAGGTTGTCAAAGTGACTATTGACTATACAGAAATTTCATTTATGCTTTGGTGTA |
| AAGATGGCCATGTAGAAACATTTTACCCAAAATTACAATCTAGTCAAGCGTGGCAACCGGGTGTTGCTATGCCTAATCTTTACAAAATGC |
| AAAGAATGCTATTAGAAAAGTGTGACCTTCAAAATTATGGTGATAGTGCAACATTACCTAAAGGCATAATGATGAATGTCGCAAAATAT |
| ACTCAACTGTGTCAATATTTAAACACATTAACATTAGCTGTACCCTATAATATGAGAGTTATACATTTTGGTGCTGGTTCTGATAAAGGAG |
| TTGCACCAGGTACAGCTGTTTTAAGACAGTGGTTGCCTACGGGTACGCTGCTTGTCGATTCAGATCTTAATGACTTTGTCTCTGATGCAG |
| ATTCAACTTTGATTGGTGATTGTGCAACTGTACATACAGCTAATAAATGGGATCTCATTATTAGTGATATGTACGACCCTAAGACTAAAA |
| ATGTTACAAAAGAAAATGACTCTAAAGAGGGTTTTTTCACTTACATTTGTGGGTTTATACAACAAAAGCTAGCTCTTGGAGGTTCCGTGG |
| CTATAAAGATAACAGAACATTCTTGGAATGCTGATCTTTATAAGCTCATGGGACACTTCGCATGGTGGACAGCCTTTGTTACTAATGTGA |
| ATGCGTCATCATCTGAAGCATTTTTAATTGGATGTAATTATCTTGGCAAACCACGCGAACAAATAGATGGTTATGTCATGCATGCAAATT |
| ACATATTTTGGAGGAATACAAATCCAATTCAGTTGTCTTCCTATTCTTTATTTGACATGAGTAAATTTCCCCTTAAATTAAGGGGTACTGCT |
| GTTATGTCTTTAAAAGAAGGTCAAATCAATGATATGATTTTATCTCTTCTTAGTAAAGGTAGACTTATAATTAGAGAAAACAACAGAGTT |
| GTTATTTCTAGTGATGTTCTTGTTAACAACTAAACGAACAATGTTTGTTTTTCTTGTTTTATTGCCACTAGTCTCTAGTCAGTGTGTTAATCT |
| TACAACCAGAACTCAATTACCCCCTGCATACACTAATTCTTTCACACGTGGTGTTTATTACCCTGACAAAGTTTTCAGATCCTCAGTTTTAC |
| ATTCAACTCAGGACTTGTTCTTACCTTTCTTTTCCAATGTTACTTGGTTCCATGCTATACATGTCTCTGGGACCAATGGTACTAAGAGGTTT |
| GATAACCCTGTCCTACCATTTAATGATGGTGTTTATTTTGCTTCCACTGAGAAGTCTAACATAATAAGAGGCTGGATTTTTGGTACTACTT |
| TAGATTCGAAGACCCAGTCCCTACTTATTGTTAATAACGCTACTAATGTTGTTATTAAAGTCTGTGAATTTCAATTTTGTAATGATCCATTT |
| TTGGGTGTTTATTACCACAAAAACAACAAAAGTTGGATGGAAAGTGAGTTCAGAGTTTATTCTAGTGCGAATAATTGCACTTTTGAATAT |
| GTCTCTCAGCCTTTTCTTATGGACCTTGAAGGAAAACAGGGTAATTTCAAAAATCTTAGGGAATTTGTGTTTAAGAATATTGATGGTTATT |
| TTAAAATATATTCTAAGCACACGCCTATTAATTTAGTGCGTGATCTCCCTCAGGGTTTTTCGGCTTTAGAACCATTGGTAGATTTGCCAAT |
| AGGTATTAACATCACTAGGTTTCAAACTTTACTTGCTTTACATAGAAGTTATTTGACTCCTGGTGATTCTTCTTCAGGTTGGACAGCTGGT |
| GCTGCAGCTTATTATGTGGGTTATCTTCAACCTAGGACTTTTCTATTAAAATATAATGAAAATGGAACCATTACAGATGCTGTAGACTGTG |
| CACTTGACCCTCTCTCAGAAACAAAGTGTACGTTGAAATCCTTCACTGTAGAAAAAGGAATCTATCAAACTTCTAACTTTAGAGTCCAACC |
| AACAGAATCTATTGTTAGATTTCCTAATATTACAAACTTGTGCCCTTTTGGTGAAGTTTTTAACGCCACCAGATTTGCATCTGTTTATGCTT |
| GGAACAGGAAGAGAATCAGCAACTGTGTTGCTGATTATTCTGTCCTATATAATTCCGCATCATTTTCCACTTTTAAGTGTTATGGAGTGTC |
| TCCTACTAAATTAAATGATCTCTGCTTTACTAATGTCTATGCAGATTCATTTGTAATTAGAGGTGATGAAGTCAGACAAATCGCTCCAGGG |
| CAAACTGGAAAGATTGCTGATTATAATTATAAATTACCAGATGATTTTACAGGCTGCGTTATAGCTTGGAATTCTAACAATCTTGATTCTA |
| AGGTTGGTGGTAATTATAATTACCTGTATAGATTGTTTAGGAAGTCTAATCTCAAACCTTTTGAGAGAGATATTTCAACTGAAATCTATCA |
| GGCCGGTAGCACACCTTGTAATGGTGTTGAAGGTTTTAATTGTTACTTTCCTTTACAATCATATGGTTTCCAACCCACTAATGGTGTTGGT |
| TACCAACCATACAGAGTAGTAGTACTTTCTTTTGAACTTCTACATGCACCAGCAACTGTTTGTGGACCTAAAAAGTCTACTAATTTGGTTA |
| AAAACAAATGTGTCAATTTCAACTTCAATGGTTTAACAGGCACAGGTGTTCTTACTGAGTCTAACAAAAAGTTTCTGCCTTTCCAACAATT |
| TGGCAGAGACATTGCTGACACTACTGATGCTGTCCGTGATCCACAGACACTTGAGATTCTTGACATTACACCATGTTCTTTTGGTGGTGTC |
| AGTGTTATAACACCAGGAACAAATACTTCTAACCAGGTTGCTGTTCTTTATCAGGATGTTAACTGCACAGAAGTCCCTGTTGCTATTCATG |
| CAGATCAACTTACTCCTACTTGGCGTGTTTATTCTACAGGTTCTAATGTTTTTCAAACACGTGCAGGCTGTTTAATAGGGGCTGAACATGT |
| CAACAACTCATATGAGTGTGACATACCCATTGGTGCAGGTATATGCGCTAGTTATCAGACTCAGACTAATTCTCCTCGGCGGGCACGTAG |

-continued

SEQUENCES

TGTAGCTAGTCAATCCATCATTGCCTACACTATGTCACTTGGTGCAGAAAATTCAGTTGCTTACTCTAATAACTCTATTGCCATACCCACAA

ATTTTACTATTAGTGTTACCACAGAAATTCTACCAGTGTCTATGACCAAGACATCAGTAGATTGTACAATGTACATTTGTGGTGATTCAAC

TGAATGCAGCAATCTTTTGTTGCAATATGGCAGTTTTTGTACACAATTAAACCGTGCTTTAACTGGAATAGCTGTTGAACAAGACAAAAA

CACCCAAGAAGTTTTTGCACAAGTCAAACAAATTTACAAAACACCACCAATTAAAGATTTTGGTGGTTTTAATTTTTCACAAATATTACCA

GATCCATCAAACCAAGCAAGAGGTCATTTATTGAAGATCTACTTTTCAACAAAGTGACACTTGCAGATGCTGGCTTCATCAAACAATAT

GGTGATTGCCTTGGTGATATTGCTGCTAGAGACCTCATTTGTGCACAAAAGTTTAACGGCCTTACTGTTTTGCCACCTTTGCTCACAGATG

AAATGATTGCTCAATACACTTCTGCACTGTTAGCGGGTACAATCACTTCTGGTTGGACCTTTGGTGCAGGTGCTGCATTACAAATACCATT

TGCTATGCAAATGGCTTATAGGTTTAATGGTATTGGAGTTACACAGAATGTTCTCTATGAGAACCAAAAATTGATTGCCAACCAATTTAA

TAGTGCTATTGGCAAAATTCAAGACTCACTTTCTTCCACAGCAAGTGCACTTGGAAAACTTCAAGATGTGGTCAACCAAAATGCACAAGC

TTTAAACACGCTTGTTAAACAACTTAGCTCCAATTTTGGTGCAATTTCAAGTGTTTTAAATGATATCCTTTCACGTCTTGACAAAGTTGAG

GCTGAAGTGCAAATTGATAGGTTGATCACAGGCAGACTTCAAAGTTTGCAGACATATGTGACTCAACAATTAATTAGAGCTGCAGAAAT

CAGAGCTTCTGCTAATCTTGCTGCTACTAAAATGTCAGAGTGTGTACTTGGACAATCAAAAAGAGTTGATTTTTGTGGAAAGGGCTATCA

TCTTATGTCCTTCCCTCAGTCAGCACCTCATGGTGTAGTCTTCTTGCATGTGACTTATGTCCCTGCACAAGAAAAGAACTTCACAACTGCTC

CTGCCATTTGTCATGATGGAAAAGCACACTTTCCTCGTGAAGGTGTCTTTGTTTCAAATGGCACACACTGGTTTGTAACACAAAGGAATT

TTTATGAACCACAAATCATTACTACAGACAACACATTTGTGTCTGGTAACTGTGATGTTGTAATAGGAATTGTCAACAACACAGTTTATGA

TCCTTTGCAACCTGAATTAGACTCATTCAAGGAGGAGTTAGATAAATATTTTAAGAATCATACATCACCAGATGTTGATTAGGTGACATC

TCTGGCATTAATGCTTCAGTTGTAAACATTCAAAAAGAAATTGACCGCCTCAATGAGGTTGCCAAGAATTTAAATGAATCTCTCATCGATC

TCCAAGAACTTGGAAAGTATGAGCAGTATATAAAATGGCCATGGTACATTTGGCTAGGTTTTATAGCTGGCTTGATTGCCATAGTAATG

GTGACAATTATGCTTTGCTGTATGACCAGTTGCTGTAGTTGTCTCAAGGGCTGTTGTTCTTGTGGATCCTGCTGCAAATTTGATGAAGAC

GACTCTGAGCCAGTGCTCAAAGGAGTCAAATTACATTACACATAAACGAACTTATGGATTTGTTTATGAGAATCTTCACAATTGGAACTG

TAACTTTGAAGCAAGGTGAAATCAAGGATGCTACTCCTTCAGATTTTGTTCGCGCTACTGCAACGATACCGATACAAGCCTCACTCCCTTT

CGGATGGCTTATTGTTGGCGTTGCACTTCTTGCTGTTTTTCAGAGCGCTTCCAAAATCATAACCCTCAAAAAGAGATGGCAACTAGCACT

CTCCAAGGGTGTTCACTTTGTTTGCAACTTGCTGTTGTTGTTTGTAACAGTTTACTCACACCTTTTGCTCGTTGCTGCTGGCCTTGAAGCCC

CTTTTCTCTATCTTTATGCTTTAGTCTACTTCTTGCAGAGTATAAACTTTGTAAGAATAATAATGAGGCTTTGGCTTTGCTGGAAATGCCGT

TCCAAAAACCCATTACTTTATGATGCCAACTATTTTCTTTGCTGGCATACTAATTGTTACGACTATTGTATACCTTACAATAGTGTAACTTCT

TCAATTGTCATTACTTCAGGTGATGGCACAACAAGTCCTATTTCTGAACATGACTACCAGATTGGTGGTTATACTGAAAAATGGGAATCT

GGAGTAAAAGACTGTGTTGTATTACACAGTTACTTCACTTCAGACTATTACCAGCTGTACTCAACTCAATTGAGTACAGACACTGGTGTT

GAACATGTTACCTTCTTCATCTACAATAAAATTGTTGATGAGCCTGAAGAACATGTCCAAATTCACACAATCGACGGTTCATCCGGAGTT

GTTAATCCAGTAATGGAACCAATTTATGATGAACCGACGACGACTACTAGCGTGCCTTTGTAAGCACAAGCTGATGAGTACGAACTTAT

GTACTCATTCGTTTCGGAAGAGACAGGTACGTTAATAGTTAATAGCGTACTTCTTTTTCTTGCTTTCGTGGTATTCTTGCTAGTTACACTAG

CCATCCTTACTGCGCTTCGATTGTGTGCGTACTGCTGCAATATTGTTAACGTGAGTCTTGTAAAACCTTCTTTTTACGTTTACTCTCGTGTT

AAAAATCTGAATTCTTCTAGAGTTCCTGATCTTCTGGTCTAAACGAACTAAATATTATATTAGTTTTTCTGTTTGGAACTTTAATTTTAGCC

ATGGCAGATTCCAACGGTACTATTACCGTTGAAGAGCTTAAAAAGCTCCTTGAACAATGGAACCTAGTAATAGGTTTCCTATTCCTTACA

TGGATTTGTCTTCTACAATTTGCCTATGCCAACAGGAATAGGTTTTTGTATATAATTAAGTTAATTTTCCTCTGGCTGTTATGGCCAGTAAC

TTTAGCTTGTTTTGTGCTTGCTGCTGTTTACAGAATAAATTGGATCACCGGTGGAATTGCTATCGCAATGGCTTGTCTTGTAGGCTTGATG

TGGCTCAGCTACTTCATTGCTTCTTTCAGACTGTTTGCGCGTACGCGTTCCATGTGGTCATTCAATCCAGAAACTAACATTCTTCTCAACGT

GCCACTCCATGGCACTATTCTGACCAGACCGCTTCTAGAAAGTGAACTCGTAATCGGAGCTGTGATCCTTCGTGGACATCTTCGTATTGC

TGGACACCATCTAGGACGCTGTGACATCAAGGACCTGCCTAAAGAAATCACTGTTGCTACATCACGAACGCTTTCTTATTACAAATTGGG

| SEQUENCES |
|---|
| AGCTTCGCAGCGTGTAGCAGGTGACTCAGGTTTTGCTGCATACAGTCGCTACAGGATTGGCAACTATAAATTAAACACAGACCATTCCA |
| GTAGCAGTGACAATATTGCTTTGCTTGTACAGTAAGTGACAACAGATGTTTCATCTCGTTGACTTTCAGGTTACTATAGCAGAGATATTAC |
| TAATTATTATGAGGACTTTTAAAGTTTCCATTTGGAATCTTGATTACATCATAAACCTCATAATTAAAAATTTATCTAAGTCACTAACTGAG |
| AATAAATATTCTCAATTAGATGAAGAGCAACCAATGGAGATTGATTAAACGAACATGAAAATTATTCTTTTCTTGGCACTGATAACACTC |
| GCTACTTGTGAGCTTTATCACTACCAAGAGTGTGTTAGAGGTACAACAGTACTTTTAAAAGAACCTTGCTCTTCTGGAACATACGAGGGC |
| AATTCACCATTTCATCCTCTAGCTGATAACAAATTTGCACTGACTTGCTTTAGCACTCAATTTGCTTTTGCTTGTCCTGACGGCGTAAAACA |
| CGTCTATCAGTTACGTGCCAGATCAGTTTCACCTAAACTGTTCATCAGACAAGAGGAAGTTCAAGAACTTTACTCTCCAATTTTTCTTATT |
| GTTGCGGCAATAGTGTTTATAACACTTTGCTTCACACTCAAAAGAAAGACAGAATGATTGAACTTTCATTAATTGACTTCTATTTGTGCTT |
| TTTAGCCTTTCTGCTATTCCTTGTTTTAATTATGCTTATTATCTTTTGGTTCTCACTTGAACTGCAAGATCATAATGAAACTTGTCACGCCTA |
| AACGAACATGAAATTTCTTGTTTTCTTAGGAATCATCACAACTGTAGCTGCATTTCACCAAGAATGTAGTTTACAGTCATGTACTCAACAT |
| CAACCATATGTAGTTGATGACCCGTGTCCTATTCACTTCTATTCTAAATGGTATATTAGAGTAGGAGCTAGAAAATCAGCACCTTTAATTG |
| AATTGTGCGTGGATGAGGCTGGTTCTAAATCACCCATTCAGTACATCGATATCGGTAATTATACAGTTTCCTGTTTACCTTTTACAATTAA |
| TTGCCAGGAACCTAAATTGGGTAGTCTTGTAGTGCGTTGTTCGTTCTATGAAGACTTTTTAGAGTATCATGACGTTCGTGTTGTTTTAGAT |
| TTCATCTAAACGAACAAACTAAAATGTCTGATAATGGACCCCAAAATCAGCGAAATGCACCCCGCATTACGTTTGGTGGACCCTCAGATT |
| CAACTGGCAGTAACCAGAATGGAGAACGCAGTGGGGCGCGATCAAAACAACGTCGGCCCCAAGGTTTACCCAATAATACTGCGTCTTG |
| GTTCACCGCTCTCACTCAACATGGCAAGGAAGACCTTAAATTCCCTCGAGGACAAGGCGTTCCAATTAACACCAATAGCAGTCCAGATGA |
| CCAAATTGGCTACTACCGAAGAGCTACCAGACGAATTCGTGGTGGTGACGGTAAAATGAAAGATCTCAGTCCAAGATGGTATTTCTACT |
| ACCTAGGAACTGGGCCAGAAGCTGGACTTCCCTATGGTGCTAACAAAGACGGCATCATATGGGTTGCAACTGAGGGAGCCTTGAATAC |
| ACCAAAAGATCACATTGGCACCCGCAATCCTGCTAACAATGCTGCAATCGTGCTACAACTTCCTCAAGGAACAACATTGCCAAAAGGCTT |
| CTACGCAGAAGGGAGCAGAGGCGGCAGTCAAGCCTCTTCTCGTTCCTCATCACGTAGTCGCAACAGTTCAAGAAATTCAACTCCAGGCA |
| GCAGTAGGGGAACTTCTCCTGCTAGAATGGCTGGCAATGGCGGTGATGCTGCTCTTGCTTTGCTGCTGCTTGACAGATTGAACCAGCTT |
| GAGAGCAAAATGTCTGGTAAAGGCCAACAACAACAAGGCCAAACTGTCACTAAGAAATCTGCTGCTGAGGCTTCTAAGAAGCCTCGGC |
| AAAAACGTACTGCCACTAAAGCATACAATGTAACACAAGCTTTCGGCAGACGTGGTCCAGAACAAACCCAAGGAAATTTTGGGGACCA |
| GGAACTAATCAGACAAGGAACTGATTACAAACATTGGCCGCAAATTGCACAATTTGCCCCCAGCGCTTCAGCGTTCTTCGGAATGTCGC |
| GCATTGGCATGGAAGTCACACCTTCGGGAACGTGGTTGACCTACACAGGTGCCATCAAATTGGATGACAAAGATCCAAATTTCAAAGAT |
| CAAGTCATTTTGCTGAATAAGCATATTGACGCATACAAAACATTCCCACCAACAGAGCCTAAAAAGGACAAAAGAAGAAGGCTGATGA |
| AACTCAAGCCTTACCGCAGAGACAGAAGAAACAGCAAACTGTGACTCTTCTTCCTGCTGCAGATTTGGATGATTTCTCCAAACAATTGCA |
| ACAATCCATGAGCAGTGCTGACTCAACTCAGGCCTAAACTCATGCAGACCACACAAGGCAGATGGGCTATATAAACGTTTTCGCTTTTCC |
| GTTTACGATATATAGTCTACTCTTGTGCAGAATGAATTCTCGTAACTACATAGCACAAGTAGATGTAGTTAACTTTAATCTCACATAGCAA |
| TCTTTAATCAGTGTGTAACATTAGGGAGGACTTGAAAGAGCCACCACATTTTCACCGAGGCCACGCGGAGTACGATCGAGTGTACAGTG |
| AACAATGCTAGGGAGAGCTGCCTATATGGAAGAGCCCTAATGTGTAAAATTAATTTTAGTAGTGCTATCCCCATGTGATTTTAATAGCTT |
| CTTAGGAGAATGACAAAAAAAAAAAAAAAAAAAAAAAAAAAAAAAA |

Severe acute respiratory syndrome coronavirus 2 orf1ab polyprotein of isolate Wuhan-Hu-1 (GenBank: QHD43415)

SEQ ID NO: 2

MESLVPGFNEKTHVQLSLPVLQVRDVLVRGFGDSVEEVLSEARQHLKDGTCGLVEVEKGVLPQLEQPYVFIKRSDARTAPHGHVMVELVAELE

GIQYGRSGETLGVLVPHVGEIPVAYRKVLLRKNGNKGAGGHSYGADLKSFDLGDELGTDPYEDFQENWNTKHSSGVTRELMRELNGGAYTRY

VDNNFCGPDGYPLECIKDLLARAGKASCTLSEQLDFIDTKRGVYCCREHEHEIAWYTERSEKSYELQTPFEIKLAKKFDTFNGECPNFVFPLNSIIK

TIQPRVEKKKLDGFMGRIRSVYPVASPNECNQMCLSTLMKCDHCGETSWQTGDFVKATCEFCGTENLTKEGATTCGYLPQNAVVKIYCPACH

NSEVGPEHSLAEYHNESGLKTILRKGGRTIAFGGCVFSYVGCHNKCAYWVPRASANIGCNHTGVVGEGSEGLNDNLLEILQKEKVNINIVGDFK

| SEQUENCES |
|---|
| LNEEIAIILASFSASTSAFVETVKGLDYKAFKQIVESCGNFKVTKGKAKKGAWNIGEQKSILSPLYAFASEAARVVRSIFSRTLETAQNSVRVLQKA |
| AITILDGISQYSLRLIDAMMFTSDLATNNLVVMAYITGGVVQLTSQWLTNIFGTVYEKLKPVLDWLEEKFKEGVEFLRDGWEIVKFISTCACEIV |
| GGQIVTCAKEIKESVQTFFKLVNKFLALCADSIIIGGAKLKALNLGETFVTHSKGLYRKCVKSREETGLLMPLKAPKEIIFLEGETLPTEVLTEEVVLK |
| TGDLQPLEQPTSEAVEAPLVGTPVCINGLMLLEIKDTEKYCALAPNMMVTNNTFTLKGGAPTKVTFGDDTVIEVQGYKSVNITFELDERIDKVL |
| NEKCSAYTVELGTEVNEFACVVADAVIKTLQPVSELLTPLGIDLDEWSMATYYLFDESGEFKLASHMYCSFYPPDEDEEEGDCEEEEFEPSTQYE |
| YGTEDDYQGKPLEFGATSAALQPEEEQEEDWLDDDSQQTVGQQDGSEDNQTTTIQTIVEVQPQLEMELTPVVQTIEVNSFSGYLKLTDNVYI |
| KNADIVEEAKKVKPTVVVNAANVYLKHGGGVAGALNKATNNAMQVESDDYIATNGPLKVGGSCVLSGHNLAKHCLHVVGPNVNKGEDIQL |
| LKSAYENFNQHEVLLAPLLSAGIFGADPIHSLRVCVDTVRTNVYLAVFDKNLYDKLVSSFLEMKSEKQVEQKIAEIPKEEVKPFITESKPSVEQRKQ |
| DDKKIKACVEEVTTTLEETKFLTENLLLYIDINGNLHPDSATLVSDIDITFLKKDAPYIVGDVVQEGVLTAVVIPTKKAGGTTEMLAKALRKVPTDN |
| YITTYPGQGLNGYTVEEAKTVLKKCKSAFYILPSIISNEKQEILGTVSWNLREMLAHAEETRKLMPVCVETKAIVSTIQRKYKGIKIQEGVVDYGAR |
| FYFYTSKTTVASLINTLNDLNETLVTMPLGYVTHGLNLEEAARYMRSLKVPATVSVSSPDAVTAYNGYLTSSSKTPEEHFIETISLAGSYKDWSYS |
| GQSTQLGIEFLKRGDKSVYYTSNPTTFHLDGEVITFDNLKTLLSLREVRTIKVFTTVDNINLHTQVVDMSMTYGQQFGPTYLDGADVTKIKPHNS |
| HEGKTFYVLPNDDTLRVEAFEYYHTTDPSFLGRYMSALNHTKKWKYPQVNGLTSIKWADNNCYLATALLTLQQIELKFNPPALQDAYYRARAG |
| EAANFCALILAYCNKTVGELGDVRETMSYLFQHANLDSCKRVLNVVCKTCGQQQTTLKGVEAVMYMGTLSYEQFKKGVQIPCTCGKQATKYL |
| VQQESPFVMMSAPPAQYELKHGTFTCASEYTGNYQCGHYKHITSKETLYCIDGALLTKSSEYKGPITDVFYKENSYTTTIKPVTYKLDGVVCTEID |
| PKLDNYYKKDNSYFTEQPIDLVPNQPYPNASFDNFKFVCDNIKFADDLNQLTGYKKPASRELKVTFFPPDLNGDVVAIDYKHYTPSFKKGAKLLHK |
| PIVWHVNNATNKATYKPNTWCIRCLWSTKPVETSNSFDVLKSEDAQGMDNLACEDLKPVSEEVVENPTIQKDVLECNVKTTEVVGDIILKPAN |
| NSLKITEEVGHTDLMAAYVDNSSLTIKKPNELSRVLGLKTLATHGLAAVNSVPWDTIANYAKPFLNKVVSTTTNIVTRCLNRVCTNYMPYFFTLL |
| LQLCTFTRSTNSRIKASMPTTIAKNTVKSVGKFCLEASFNYLKSPNFSKLINIIIWFLLLSVCLGSLIYSTAALGVLMSNLGMPSYCTGYREGYLNST |
| NVTIATYCTGSIPCSVCLSGLDSLDTYPSLETIQITISSFKWDLTAFGLVAEWFLAYILFTRFFYVLGLAAIMQLFFSYFAVHFISNSWLMWLIINLV |
| QMAPISAMVRMYIFFASFYYVWKSYVHVVDGCNSSTCMMCYKRNRATRVECTTIVNGVRRSFYVYANGGKGFCKLHNWNCVNCDTFCAG |
| STFISDEVARDLSLQFKRPINPTDQSSYIVDSVTVKNGSIHLYFDKAGQKTYERHSLSHFVNLDNLRANNTKGSLPINVIVFDGKSKCEESSAKSAS |
| VYYSQLMCQPILLLDQALVSDVGDSAEVAVKMFDAYVNTFSSTFNVPMEKLKTLVATAEAELAKNVSLDNVLSTFISAARQGFVDSDVETKDV |
| VECLKLSHQSDIEVTGDSCNNYMLTYNKVENMTPRDLGACIDCSARHINAQVAKSHNIALIWNVKDFMSLSEQLRKQIRSAAKKNNLPFKLTC |
| ATTRQVVNVVTTKIALKGGKIVNNWLKQLIKVTLVFLFVAAIFYLITPVHVMSKHTDFSSEIIGYKAIDGGVTRDIASTDTCFANKHADFDTWFS |
| QRGGSYTNDKACPLIAAVITREVGFVVPGLPGTILRTTNGDFLHFLPRVFSAVGNICYTPSKLIEYTDFATSACVLAAECTIFKDASGKPVPYCYDT |
| NVLEGSVAYESLRPDTRYVLMDGSIIQFPNTYLEGSVRVVTTFDSEYCRHGTCERSEAGVCVSTSGRWVLNNDYYRSLPGVFCGVDAVNLLTN |
| MFTPLIQPIGALDISASIVAGGIVAIVVTCLAYYFMRFRRAFGEYSHVVAFNTLLFLMSFTVLCLTPVYSFLPGVYSVIYLYLTFYLTNDVSFLAHIQ |
| WMVMFTPLVPFWITIAYIICISTKHFYWFFSNYLKRRVVFNGVSFSTFEEAALCTFLLNKEMYLKLRSDVLLPLTQYNRYLALYNKYKYFSGAMD |
| TTSYREAACCHLAKALNDFSNSGSDVLYQPPQTSITSAVLQSGFRKMAFPSGKVEGCMVQVTCGTTTLNGLWLDDVVYCPRHVICTSEDMLN |
| PNYEDLLIRKSNHNFLVQAGNVQLRVIGHSMQNCVLKLKVDTANPKTPKYKFVRIQPGQTFSVLACYNGSPSGVYQCAMRPNFTIKGSFLNGS |
| CGSVGFNIDYDCVSFCYMHHMELPTGVHAGTDLEGNFYGPFVDRQTAQAAGTDTTITVNVLAWLYAAVINGDRWFLNRFTTTLNDFNLVA |
| MKYNYEPLTQDHVDILGPLSAQTGIAVLDMCASLKELLQNGMNGRTILGSALLEDEFTPFDVVRQCSGVTFQSAVKRTIKGTHHWLLLTILTSL |
| LVLVQSTQWSLFFFLYENAFLPFAMGIIAMSAFAMMFVKHKHAFLCLFLLPSLATVAYFNMVYMPASWVMRIMTWLDMVDTSLSGFKLKD |
| CVMYASAVVLLILMTARTVYDDGARRVWTLMNVLTLVYKVYYGNALDQAISMWALIISVTSNYSGVVTTVMFLARGIVFMCVEYCPIFFITGN |
| TLQCIMLVYCFLGYFCTCYFGLFCLLNRYFRLTLGVYDYLVSTQEFRYMNSQGLLPPKNSIDAFKLNIKLLGVGGKPCIKVATVQSKMSDVKCTSV |
| VLLSVLQQLRVESSSKLWAQCVQLHNDILLAKDTTEAFEKMVSLLSVLLSMQGAVDINKLCEEMLDNRATLQAIASEFSSLPSYAAFATAQEAY |
| EQAVANGDSEVVLKKLKKSLNVAKSEFDRDAAMQRKLEKMADQAMTQMYKQARSEDKRAKVTSAMQTMLFTMLRKLDNDALNNIINNA |
| RDGCVPLNIIPLTTAAKLMVVIPDYNTYKNTCDGTTFTYASALWEIQQVVDADSKIVQLSEISMDNSPNLAWPLIVTALRANSAVKLQNNELSP |

SEQUENCES

VALRQMSCAAGTTQTACTDDNALAYYNTTKGGRFVLALLSDLQDLKWARFPKSDGTGTIYTELEPPCRFVTDTPKGPKVKYLYFIKGLNNLNR

GMVLGSLAATVRLQAGNATEVPANSTVLSFCAFAVDAAKAYKDYLASGGQPITNCVKMLCTHTGTGQAITVTPEANMDQESFGGASCCLYC

RCHIDHPNPKGFCDLKGKYVQIPTTCANDPVGFTLKNTVCTVCGMWKGYGCSCDQLREPMLQSADAQSFLNRVCGVSAARLTPCGTGTSTD

VVYRAFDIYNDKVAGFAKFLKTNCCRFQEKDEDDNLIDSYFVVKRHTFSNYQHEETIYNLLKDCPAVAKHDFFKFRIDGDMVPHISRQRLTKYT

MADLVYALRHFDEGNCDTLKEILVTYNCCDDDYFNKKDWYDFVENPDILRVYANLGERVRQALLKTVQFCDAMRNAGIVGVLTLDNQDLNG

NWYDFGDFIQTTPGSGVPVVDSYYSLLMPILTLTRALTAESHVDTDLTKPYIKWDLLKYDFTEERLKLFDRYFKYWDQTYHPNCVNCLDDRCIL

HCANFNVLFSTVFPPTSFGPLVRKIFVDGVPFVVSTGYHFRELGVVHNQDVNLHSSRLSFKELLVYAADPAMHAASGNLLLDKRTTCFSVAALT

NNVAFQTVKPGNFNKDFYDFAVSKGFFKEGSSVELKHFFFAQDGNAAISDYDYYRYNLPTMCDIRQLLFVVEVVDKYFDCYDGGCINANQVIV

NNLDKSAGFPFNKWGKARLYYDSMSYEDQDALFAYTKRNVIPTITQMNLKYAISAKNRARTVAGVSICSTMTNRQFHQKLLKSIAATRGATVV

IGTSKFYGGWHNMLKTVYSDVENPHLMGWDYPKCDRAMPNMLRIMASLVLARKHTTCCSLSHRFYRLANECAQVLSEMVMCGGSLYVKP

GGTSSGDATTAYANSVFNICQAVTANVNALLSTDGNKIADKYVRNLQHRLYECLYRNRDVDTDFVNEFYAYLRKHFSMMILSDDAVVCFNST

YASQGLVASIKNFKSVLYYQNNVFMSEAKCWTETDLTKGPHEFCSQHTMLVKQGDDYVYLPYPDPSRILGAGCFVDDIVKTDGTLMIERFVSL

AIDAYPLTKHPNQEYADVFHLYLQYIRKLHDELTGHMLDMYSVMLTNDNTSRYWEPEFYEAMYTPHTVLQAVGACVLCNSQTSLRCGACIRR

PFLCCKCCYDHVISTSHKLVLSVNPYVCNAPGCDVTDVTQLYLGGMSYYCKSHKPPISFPLCANGQVFGLYKNTCVGSDNVTDFNAIATCDWT

NAGDYILANTCTERLKLFAAETLKATEETFKLSYGIATVREVLSDRELHLSWEVGKPRPPLNRNYVFTGYRVTKNSKVQIGEYTFEKGDYGDAVV

YRGTTTYKLNVGDYFVLTSHTVMPLSAPTLVPQEHYVRITGLYPTLNISDEFSSNVANYQKVGMQKYSTLQGPPGTGKSHFAIGLALYYPSARIV

YTACSHAAVDALCEKALKYLPIDKCSRIIPARARVECFDKFKVNSTLEQYVFCTVNALPETTADIVVFDEISMATNYDLSVVNARLRAKHYVYIGD

PAQLPAPRTLLTKGTLEPEYFNSVCRLMKTIGPDMFLGTCRRCPAEIVDTVSALVYDNKLKAHKDKSAQCFKMFYKGVITHDVSSAINRPQIGV

VREFLTRNPAWRKAVFISPYNSQNAVASKILGLPTQVDSSQGSEYDYVIFTQTTETAHSCNVNRFNVAITRAKVGILCIMSDRDLYDKLQFTSL

EIPRRNVATLQAENVTGLFKDCSKVITGLHPTQAPTHLSVDTKFKTEGLCVDIPGIPKDMTYRRLISMMGFKMNYQVNGYPNMFITREEAIRH

VRAWIGFDVEGCHATREAVGTNLPLQLGFSTGVNLVAVPTGYVDTPNNTDFSRVSAKPPPGDQFKHLIPLMYKGLPWNVVRIKIVQMLSDTL

KNLSDRVVFVLWAHGFELTSMKYFVKIGPERTCCLCDRRATCFSTASDTYACWHHSIGFDYVYNPFMIDVQQWGFTGNLQSNHDLYCQVHG

NAHVASCDAIMTRCLAVHECFVKRVDWTIEYPIIGDELKINAACRKVQHMVVKAALLADKFPVLHDIGNPKAIKCVPQADVEWKFYDAQPCS

DKAYKIEELFYSYATHSDKFTDGVCLFWNCNVDRYPANSIVCRFDTRVLSNLNLPGCDGGSLYVNKHAFHTPAFDKSAFVNLKQLPFFYYSDSP

CESHGKQVVSDIDYVPLKSATCITRCNLGGAVCRHHANEYRLYLDAYNMMISAGFSLWVYKQFDTYNLWNTFTRLQSLENVAFNVVNKGHF

DGQQGEVPVSIINNTVYTKVDGVDVELFENKTTLPVNVAFELWAKRNIKPVPEVKILNNLGVDIAANTVIWDYKRDAPAHISTIGVCSMTDIAK

KPTETICAPLTVFFDGRVDGQVDLFRNARNGVLITEGSVKGLQPSVGPKQASLNGVTLIGEAVKTQFNYYKKVDGVVQQLPETYFTQSRNLQE

FKPRSQMEIDFLELAMDEFIERYKLEGYAFEHIVYGDFSHSQLGGLHLLIGLAKRFKESPFELEDFIPMDSTVKNYFITDAQTGSSKCVCSVIDLLL

DDFVEIIKSQDLSVVSKVVKVTIDYTEISFMLWCKDGHVETFYPKLQSSQAWQPGVAMPNLYKMQRMLLEKCDLQNYGDSATLPKGIMMNV

AKYTQLCQYLNTLTLAVPYNMRVIHFGAGSDKGVAPGTAVLRQWLPTGTLLVDSDLNDFVSDADSTLIGDCATVHTANKWDLIISDMYDPKT

KNVTKENDSKEGFFTYICGFIQQKLALGGSVAIKITEHSWNADLYKLMGHFAWWTAFVTNVNASSSEAFLIGCNYLGKPREQIDGYVMHANYI

FWRNTNPIQLSSYSLFDMSKFPLKLRGTAVMSLKEGQINDMILSLLSKGRLIIRENNRVVISSDVLVNN

Severe acute respiratory syndrome coronavirus 2 surface glycoprotein (GenBank: QHD43416)

SEQ ID NO: 3

MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFAS

TEKSNIIRGWIFGTTLDSKTQSLLIVNNATNVVIKVCEFQFCNDPFLGVYYHKNNKSWMESEFRVYSSANNCTFEYVSQPFLMDLEGKQGNFK

NLREFVFKNIDGYFKIYSKHTPINLVRDLPQGFSALEPLVDLPIGINITRFQTLLALHRSYLTPGDSSSGWTAGAAAYYVGYLQPRTFLLKYNENGT

ITDAVDCALDPLSETKCTLKSFTVEKGIYQTSNFRVQPTESIVRFPNITNLCPFGEVFNATRFASVYAWNRKRISNCVADYSVLYNSASFSTFKCYG

VSPTKLNDLCFTNVYADSFVIRGDEVRQIAPGQTGKIADYNYKLPDDFTGCVIAWNSNNLDSKVGGNYNYLYRLFRKSNLKPFERDISTEIYQAG

| SEQUENCES | |
|---|---|
| STPCNGVEGFNCYFPLQSYGFQPTNGVGYQPYRVVVLSFELLHAPATVCGPKKSTNLVKNKCVNFNFNGLTGTGVLTESNKKFLPFQQFGRDI ADTTDAVRDPQTLEILDITPCSFGGVSVITPGTNTSNQVAVLYQDVNCTEVPVAIHADQLTPTWRVYSTGSNVFQTRAGCLIGAEHVNNSYEC DIPIGAGICASYQTQTNSPRRARSVASQSIIAYTMSLGAENSVAYSNNSIAIPTNFTISVTTEILPVSMTKTSVDCTMYICGDSTECSNLLLQYGSF CTQLNRALTGIAVEQDKNTQEVFAQVKQIYKTPPIKDFGGFNFSQILPDPSKPSKRSFIEDLLFNKVTLADAGFIKQYGDCLGDIAARDLICAQKF NGLTVLPPLLTDEMIAQYTSALLAGTITSGWTFGAGAALQIPFAMQMAYRFNGIGVTQNVLYENQKLIANQFNSAIGKIQDSLSSTASALGKLQ DVVNQNAQALNTLVKQLSSNFGAISSVLNDILSRLDKVEAEVQIDRLITGRLQSLQTYVTQQLIRAAEIRASANLAATKMSECVLGQSKRVDFC GKGYHLMSFPQSAPHGVVFLHVTYVPAQEKNFTTAPAICHDGKAHFPREGVFVSNGTHWFVTQRNFYEPQIITTDNTFVSGNCDVVIGIVNN TVYDPLQPELDSFKEELDKYFKNHTSPDVDLGDISGINASVVNIQKEIDRLNEVAKNLNESLIDLQELGKYEQYIKWPWYIWLGFIAGLIAIVMVT IMLCCMTSCCSCLKGCCSCGSCCKFDEDDSEPVLKGVKLHYT | |
| CpG 1018<br>TGACTGTGAACGTTCGAGATGA | SEQ ID NO: 4 |
| KLK peptide<br>KLKLLLLLKLK | SEQ ID NO: 5 |
| Oligo-d(IC)₁₃(ODN1a)<br>ICICICICICICICICICICICIC | SEQ ID NO: 6 |
| CpG 1826<br>TCCATGACGTTCCTGACGTT | SEQ ID NO: 7 |
| CpG 7909<br>TCGTCGTTTTGTCGTTTTGTCGTT | SEQ ID NO: 8 |
| >hCoV-19/Italy/INMI1-isI/2020\|EPI_ISL_410545\|2020-01-29 (Accession No: MT066156)<br>ATTAAAGGTTTATACCTTCCCAGGTAACAAACCAACCAACTTTCGATCTCTTGTAGATCTGTTCTCTAAACGAACTTTAAAATCTGTGTGG CTGTCACTCGGCTGCATGCTTAGTGCACTCACGCAGTATAATTAATAACTAATTACTGTCGTTGACAGGACACGAGTAACTCGTCTATCTT CTGCAGGCTGCTTACGGTTTCGTCCGTGTTGCAGCCGATCATCAGCACATCTAGGTTTCGTCCGGGTGTGACCGAAAGGTAAGATGGAG AGCCTTGTCCCTGGTTTCAACGAGAAAACACACGTCCAACTCAGTTTGCCTGTTTTACAGGTTCGCGACGTGCTCGTACGTGGCTTTGGA GACTCCGTGGAGGAGGTCTTATCAGAGGCACGTCAACATCTTAAAGATGGCACTTGTGGCTTAGTAGAAGTTGAAAAAGGCGTTTTGCC TCAACTTGAACAGCCCTATGTGTTCATCAAACGTTCGGATGCTCGAACTGCACCTCATGGTCATGTTATGGTTGAGCTGGTAGCAGAACT CGAAGGCATTCAGTACGGTCGTAGTGGTGAGACACTTGGTGTCCTTGTCCCTCATGTGGGCGAAATACCAGTGGCTTACCGCAAGGTTC TTCTTCGTAAGAACGGTAATAAAGGAGCTGGTGGCCATAGTTACGGCGCCGATCTAAAGTCATTTGACTTAGGCGACGAGCTTGGCACT GATCCTTATGAAGATTTTCAAGAAAACTGGAACACTAAACATAGCAGTGGTGTTACCCGTGAACTCATGCGTGAGCTTAACGGAGGGGC ATACACTCGCTATGTCGATAACAACTTCTGTGGCCCTGATGGCTACCCTCTTGAGTGCATTAAAGACCTTCTAGCACGTGCTGGTAAAGC TTCATGCACTTTGTCCGAACAACTGGACTTTATTGACACTAAGAGGGGTGTATACTGCTGCCGTGAACATGAGCATGAAATTGCTTGGTA CACGGAACGTTCTGAAAAGAGCTATGAATTGCAGACACCTTTTGAAATTAAATTGGCAAAGAAATTTGACACCTTCAATGGGGAATGTC CAAATTTTGTATTTCCCTTAAATTCCATAATCAAGACTATTCAACCAAGGGTTGAAAAGAAAAAGCTTGATGGCTTTATGGGTAGAATTC GATCTGTCTATCCAGTTGCGTCACCAAATGAATGCAACCAAATGTGCCTTTCAACTCTCATGAAGTGTGATCATTGTGGTGAAACTTCATG GCAGACGGGCGATTTTGTTAAAGCCACTTGCGAATTTTGTGGCACTGAGAATTTGACTAAAGAAGGTGCCACTACTTGTGGTTACTTACC CCAAAATGCTGTTGTTAAAATTTATTGTCCAGCATGTCACAATTCAGAAGTAGGACCTGAGCATAGTCTTGCCGAATACCATAATGAATC TGGCTTGAAAACCATTCTTCGTAAGGGTGGTCGCACTATTGCCTTTGGAGGCTGTGTGTTCTCTTATGTTGGTTGCCATAACAAGTGTGC CTATTGGGTTCCACGTGCTAGCGCTAACATAGGTTGTAACCATACAGGTGTTGTTGGAGAAGGTTCCGAAGGTCTTAATGACAACCTTCT TGAAATACTCCAAAAAGAGAAAGTCAACATCAATATTGTTGGTGACTTTAAACTTAATGAAGAGATCGCCATTATTTTGGCATCTTTTTCT | SEQ ID NO: 9 |

| SEQUENCES |
| --- |
| GCTTCCACAAGTGCTTTTGTGGAAACTGTGAAAGGTTTGGATTATAAAGCATTCAAACAAATTGTTGAATCCTGTGGTAATTTTAAAGTT |
| ACAAAAGGAAAAGCTAAAAAAGGTGCCTGGAATATTGGTGAACAGAAATCAATACTGAGTCCTCTTTATGCATTTGCATCAGAGGCTGC |
| TCGTGTTGTACGATCAATTTTCTCCCGCACTCTTGAAACTGCTCAAAATTCTGTGCGTGTTTTACAGAAGGCCGCTATAACAATACTAGAT |
| GGAATTTCACAGTATTCACTGAGACTCATTGATGCTATGATGTTCACATCTGATTTGGCTACTAACAATCTAGTTGTAATGGCCTACATTA |
| CAGGTGGTGTTGTTCAGTTGACTTCGCAGTGGCTAACTAACATCTTTGGCACTGTTTATGAAAAACTCAAACCCGTCCTTGATTGGCTTGA |
| AGAGAAGTTTAAGGAAGGTGTAGAGTTTCTTAGAGACGGTTGGGAAATTGTTAAATTTATCTCAACCTGTGCTTGTGAAATTGTCGGTG |
| GACAAATTGTCACCTGTGCTAAGGAAATTAAGGAGAGTGTTCAGACATTCTTTAAGCTTGTAAATAAATTTTTGGCTTTGTGTGCTGACT |
| CTATCATTATTGGTGGAGCTAAACTTAAAGCCTTGAATTTAGGTGAAACATTTGTCACGCACTCAAAGGGATTGTACAGAAAGTGTGTTA |
| AATCCAGAGAAGAAACTGGCCTACTCATGCCTCTAAAAGCCCCAAAAGAAATTATCTTCTTAGAGGGAGAAACACTTCCCACAGAAGTG |
| TTAACAGAGGAAGTTGTCTTGAAAACTGGTGATTTACAACCATTAGAACAACCTACTAGTGAAGCTGTTGAAGCTCCATTGGTTGGTACA |
| CCAGTTTGTATTAACGGGCTTATGTTGCTCGAAATCAAAGACACAGAAAAGTACTGTGCCCTTGCACCTAATATGATGGTAACAAACAAT |
| ACCTTCACACTCAAAGGCGGTGCACCAACAAAGGTTACTTTTGGTGATGACACTGTGATAGAAGTGCAAGGTTACAAGAGTGTGAATAT |
| CACTTTTGAACTTGATGAAAGGATTGATAAAGTACTTAATGAGAAGTGCTCTGCCTATACAGTTGAACTCGGTACAGAAGTAAATGAGTT |
| CGCCTGTGTTGTGGCAGATGCTGTCATAAAAACTTTGCAACCAGTATCTGAATTACTTACACCACTGGGCATTGATTTAGATGAGTGGAG |
| TATGGCTACATACTACTTATTTGATGAGTCTGGTGAGTTTAAATTGGCTTCACATATGTATTGTTCTTTCTACCCTCCAGATGAGGATGAA |
| GAAGAAGGTGATTGTGAAGAAGAAGAGTTTGAGCCATCAACTCAATATGAGTATGGTACTGAAGATGATTACCAAGGTAAACCTTTGG |
| AATTTGGTGCCACTTCTGCTGCTCTTCAACCTGAAGAAGAGCAAGAAGAAGATTGGTTAGATGATGATAGTCAACAAACTGTTGGTCAA |
| CAAGACGGCAGTGAGGACAATCAGACAACTACTATTCAAACAATTGTTGAGGTTCAACCTCAATTAGAGATGGAACTTACACCAGTTGT |
| TCAGACTATTGAAGTGAATAGTTTTAGTGGTTATTTAAAACTTACTGACAATGTATACATTAAAAATGCAGACATTGTGGAAGAAGCTAA |
| AAAGGTAAAACCAACAGTGGTTGTTAATGCAGCCAATGTTTACCTTAAACATGGAGGAGGTGTTGCAGGAGCCTTAAATAAGGCTACTA |
| ACAATGCCATGCAAGTTGAATCTGATGATTACATAGCTACTAATGGACCACTTAAAGTGGGTGGTAGTTGTGTTTTAAGCGGACACAATC |
| TTGCTAAACACTGTCTTCATGTTGTCGGCCCAAATGTTAACAAAGGTGAAGACATTCAACTTCTTAAGAGTGCTTATGAAAATTTTAATCA |
| GCACGAAGTTCTACTTGCACCATTATTATCAGCTGGTATTTTTGGTGCTGACCCTATACATTCTTTAAGAGTTTGTGTAGATACTGTTCGCA |
| CAAATGTCTACTTAGCTGTCTTTGATAAAAATCTCTATGACAAACTTGTTTCAAGCTTTTTGGAAATGAAGAGTGAAAAGCAAGTTGAAC |
| AAAAGATCGCTGAGATTCCTAAAGAGGAAGTTAAGCCATTTATAACTGAAAGTAAACCTCAGTTGAACAGAGAAAACAAGATGATAAG |
| AAAATCAAAGCTTGTGTTGAAGAAGTTACAACAACTCTGGAAGAAACTAAGTTCCTCACAGAAAACTTGTTACTTTATATTGACATTAAT |
| GGCAATCTTCATCCAGATTCTGCCACTCTTGTTAGTGACATTGACATCACTTTCTTAAAGAAAGATGCTCCATATATAGTGGGTGATGTTG |
| TTCAAGAGGGTGTTTTAACTGCTGTGGTTATACCTACTAAAAAGGCTGGTGGCACTACTGAAATGCTAGCGAAAGCTTTGAGAAAGTG |
| CCAACAGACAATTATATAACCACTTACCCGGGTCAGGGTTTAAATGGTTACACTGTAGAGGAGGCAAAGACAGTGCTTAAAAAGTGTAA |
| AAGTGCCTTTTACATTCTACCATCTATTATCTCTAATGAGAAGCAAGAAATTCTTGGAACTGTTTCTTGGAATTTGCGAGAAATGCTTGCA |
| CATGCAGAAGAAACACGCAAATTAATGCCTGTCTGTGTGGAAACTAAAGCCATAGTTTCAACTATACAGCGTAAATATAAGGGTATTAA |
| AATACAAGAGGGTGTGGTTGATTATGGTGCTAGATTTTACTTTTACACCAGTAAAACAACTGTAGCGTCACTTATCAACACACTTAACGA |
| TCTAAATGAAACTCTTGTTACAATGCCACTTGGCTATGTAACACATGGCTTAAATTTGGAAGAAGCTGCTCGGTATATGAGATCTCTCAA |
| AGTGCCAGCTACAGTTTCTGTTTCTTCACCTGATGCTGTTACAGCGTATAATGGTTATCTTACTTCTTCTTCTAAAACACCTGAAGAACATT |
| TTATTGAAACCATCTCACTTGCTGGTTCCTATAAAGATTGGTCCTATTCTGGACAATCTACACAACTAGGTATAGAATTTCTTAAGAGAGG |
| TGATAAAAGTGTATATTACACTAGTAATCCTACCACATTCCACCTAGATGGTGAAGTTATCACCTTTGACAATCTTAAGACACTTCTTTCTT |
| TGAGAGAAGTGAGGACTATTAAGGTGTTTACAACAGTAGACAACATTAACCTCCACACGCAAGTTGTGGACATGTCAATGACATATGGA |
| CAACAGTTTGGTCCAACTTATTTGGATGGAGCTGATGTTACTAAAATAAAACCTCATAATTCACATGAAGGTAAAACATTTTATGTTTTAC |

| SEQUENCES |
|---|
| CTAATGATGACACTCTACGTGTTGAGGCTTTTGAGTACTACCACACAACTGATCCTAGTTTTCTGGGTAGGTACATGTCAGCATTAAATCA |
| CACTAAAAAGTGGAAATACCCACAAGTTAATGGTTTAACTTCTATTAAATGGGCAGATAACAACTGTTATCTTGCCACTGCATTGTTAACA |
| CTCCAACAAATAGAGTTGAAGTTTAATCCACCTGCTCTACAAGATGCTTATTACAGAGCAAGGGCTGGTGAAGCTGCTAACTTTTGTGCA |
| CTTATCTTAGCCTACTGTAATAAGACAGTAGGTGAGTTAGGTGATGTTAGAGAAACAATGAGTTACTTGTTTCAACATGCCAATTTAGAT |
| TCTTGCAAAAGAGTCTTGAACGTGGTGTGTAAAACTTGTGGACAACAGCAGACAACCCTTAAGGGTGTAGAAGCTGTTATGTACATGGG |
| CACACTTTCTTATGAACAATTTAAGAAAGGTGTTCAGATACCTTGTACGTGTGGTAAACAAGCTACAAAATATCTAGTACAACAGGAGTC |
| ACCTTTTGTTATGATGTCAGCACCACCTGCTCAGTATGAACTTAAGCATGGTACATTTACTTGTGCTAGTGAGTACACTGGTAATTACCAG |
| TGTGGTCACTATAAACATATAACTTCTAAAGAAACTTTGTATTGCATAGACGGTGCTTTACTTACAAAGTCCTCAGAATACAAAGGTCCTA |
| TTACGGATGTTTTCTACAAAGAAAACAGTTACACAACAACCATAAAACCAGTTACTTATAAATTGGATGGTGTTGTTTGTACAGAAATTG |
| ACCCTAAGTTGGACAATTATTATAAGAAAGACAATTCTTATTTCACAGAGCAACCAATTGATCTTGTACCAAACCAACCATATCCAAACGC |
| AAGCTTCGATAATTTTAAGTTTGTATGTGATAATATCAAATTTGCTGATGATTTAAACCAGTTAACTGGTTATAAGAAACCTGCTTCAAGA |
| GAGCTTAAAGTTACATTTTTCCCTGACTTAAATGGTGATGTGGTGGCTATTGATTATAAACACTACACACCCTCTTTTAAGAAAGGAGCTA |
| AATTGTTACATAAACCTATTGTTTGGCATGTTAACAATGCAACTAATAAAGCCACGTATAAACCAAATACCTGGTGTATACGTTGTCTTTG |
| GAGCACAAAACCAGTTGAAACATCAAATTCGTTTGATGTACTGAAGTCAGAGGACGCGCAGGGAATGGATAATCTTGCCTGCGAAGAT |
| CTAAAACCAGTCTCTGAAGAAGTAGTGGAAAATCCTACCATACAGAAAGACGTTCTTGAGTGTAATGTGAAAACTACCGAAGTTGTAGG |
| AGACATTATACTTAAACCAGCAAATAATAGTTTAAAAATTACAGAAGAGGTTGGCCACACAGATCTAATGGCTGCTTATGTAGACAATTC |
| TAGTCTTACTATTAAGAAACCTAATGAATTATCTAGAGTATTAGGTTTGAAAACCCTTGCTACTCATGGTTTAGCTGCTGTTAATAGTGTC |
| CCTTGGGATACTATAGCTAATTATGCTAAGCCTTTTCTTAACAAAGTTGTTAGTACAACTACTAACATAGTTACACGGTGTTTAAACCGTG |
| TTTGTACTAATTATATGCCTTATTTCTTTACTTTATTGCTACAATTGTGTACTTTTACTAGAAGTACAAATTCTAGAATTAAAGCATCTATGC |
| CGACTACTATAGCAAAGAATACTGTTAAGAGTGTCGGTAAATTTTGTCTAGAGGCTTCATTTAATTATTTGAAGTCACCTAATTTTTCTAA |
| ACTGATAAATATTATAATTTGGTTTTTACTATTAAGTGTTTGCCTAGGTTCTTTAATCTACTCAACCGCTGCTTTAGGTGTTTTAATGTCTAA |
| TTTAGGCATGCCTTCTTACTGTACTGGTTACAGAGAAGGCTATTTGAACTCTACTAATGTCACTATTGCAACCTACTGTACTGGTTCTATAC |
| CTTGTAGTGTTTGTCTTAGTGGTTTAGATTCTTTAGACACCTATCCTTCTTTAGAAACTATACAAATTACCATTTCATCTTTTAAATGGGATT |
| TAACTGCTTTTGGCTTAGTTGCAGAGTGGTTTTTGGCATATATTCTTTTCACTAGGTTTTTCTATGTACTTGGATTGGCTGCAATCATGCAA |
| TTGTTTTTCAGCTATTTTGCAGTACATTTTATTAGTAATTCTTGGCTTATGTGGTTAATAATTAATCTTGTACAAATGGCCCCGATTTCAGCT |
| ATGGTTAGAATGTACATCTTCTTTGCATCATTTTATTATGTATGGAAAAGTTATGTGCATGTTGTAGACGGTTGTAATTCATCAACTTGTAT |
| GATGTGTTACAAACGTAATAGAGCAACAAGAGTCGAATGTACAACTATTGTTAATGGTGTTAGAAGGTCCTTTTATGTCTATGCTAATGG |
| AGGTAAAGGCTTTTGCAAACTACACAATTGGAATTGTGTTAATTGTGATACATTCTGTGCTGGTAGTACATTTATTAGTGATGAAGTTGC |
| GAGAGACTTGTCACTACAGTTTAAAAGACCAATAAATCCTACTGACCAGTCTTCTTACATCGTTGATAGTGTTACAGTGAAGAATGGTTC |
| CATCCATCTTTACTTTGATAAAGCTGGTCAAAAGACTTATGAAAGACATTCTCTCTCATTTTGTTAACTTAGACAACCTGAGAGCTAAT |
| AACACTAAAGGTTCATTGCCTATTAATGTTATAGTTTTTGATGGTAAATCAAAATGTGAAGAATCATCTGCAAAATCAGCGTCTGTTTACT |
| ACAGTCAGCTTATGTGTCAACCTATACTGTTACTAGATCAGGCATTAGTGTCTGATGTTGGTGATAGTGCGGAAGTTGCAGTTAAAATGT |
| TTGATGCTTACGTTAATACGTTTTCATCAACTTTTAACGTACCAATGGAAAAACTCAAAACACTAGTTGCAACTGCAGAAGCTGAACTTGC |
| AAAGAATGTGTCCTTAGACAATGTCTTATCTACTTTTATTTCAGCAGCTCGGCAAGGGTTTGTTGATTCAGATGTAGAAACTAAAGATGTT |
| GTTGAATGTCTTAAATTGTCACATCAATCTGACATAGAAGTTACTGGCGATAGTTGTAATAACTATATGCTCACCTATAACAAAGTTGAAA |
| ACATGACACCCCGTGACCTTGGTGCTTGTATTGACTGTAGTGCGCGTCATATTAATGCGCAGGTAGCAAAAAGTCACAACATTGCTTTGA |
| TATGGAACGTTAAAGATTTCATGTCATTGTCTGAACAACTACGAAAACAAATACGTAGTGCTGCTAAAAAGAATAACTTACCTTTTAAGT |
| TGACATGTGCAACTACTAGACAAGTTGTTAATGTTGTAACAACAAAGATAGCACTTAAGGGTGGTAAAATTGTTAATAATTGGTTGAAG |
| CAGTTAATTAAAGTTACACTTGTGTTCCTTTTTGTTGCTGCTATTTTCTATTTAATAACACCTGTTCATGTCATGTCTAAACATACTGACTTT |

-continued

| SEQUENCES |
| --- |
| TCAAGTGAAATCATAGGATACAAGGCTATTGATGGTGGTGTCACTCGTGACATAGCATCTACAGATACTTGTTTTGCTAACAAACATGCT |
| GATTTTGACACATGGTTTAGCCAGCGTGGTGGTAGTTATACTAATGACAAAGCTTGCCCATTGATTGCTGCAGTCATAACAAGAGAAGT |
| GGGTTTTGTCGTGCCTGGTTTGCCTGGCACGATATTACGCACAACTAATGGTGACTTTTGCATTTCTTACCTAGAGTTTTTAGTGCAGTT |
| GGTAACATCTGTTACACACCATCAAAACTTATAGAGTACACTGACTTTGCAACATCAGCTTGTGTTTTGGCTGCTGAATGTACAATTTTTA |
| AAGATGCTTCTGGTAAGCCAGTACCATATTGTTATGATACCAATGTACTAGAAGGTTCTGTTGCTTATGAAAGTTTACGCCCTGACACAC |
| GTTATGTGCTCATGGATGGCTCTATTATTCAATTTCCTAACACCTACCTTGAAGGTTCTGTTAGAGTGGTAACAACTTTTGATTCTGAGTA |
| CTGTAGGCACGGCACTTGTGAAAGATCAGAAGCTGGTGTTTGTATCTACTAGTGGTAGATGGGTACTTAACAATGATTATTACAGAT |
| CTTTACCAGGAGTTTTCTGTGGTGTAGATGCTGTAAATTTACTTACTAATATGTTTACACCACTAATTCAACCTATTGTGCTTTGGACATA |
| TCAGCATCTATAGTAGCTGGTGGTATTGTAGCTATCGTAGTAACATGCCTTGCCTACTATTTTATGAGGTTTAGAAGAGCTTTTGGTGAAT |
| ACAGTCATGTAGTTGCCTTTAATACTTTACTATTCCTTATGTCATTCACTGTACTCTGTTTAACACCAGTTTACTCATTCTTACCTGGTGTTT |
| ATTCTGTTATTTACTTGTACTTGACATTTTATCTTACTAATGATGTTTCTTTTTTAGCACATATTCAGTGGATGGTTATGTTCACACCTTTAG |
| TACCTTTCTGGATAACAATTGCTTATATCATTTGTATTTCCACAAAGCATTTCTATTGGTTCTTTAGTAATTACCTAAAGAGACGTGTAGTC |
| TTTAATGGTGTTTCCTTTAGTACTTTTGAAGAAGCTGCGCTGTGCACCTTTTTGTTAAATAAAGAAATGTATCTAAAGTTGCGTAGTGATG |
| TGCTATTACCTCTTACGCAATATAATAGATACTTAGCTCTTTATAATAAGTACAAGTATTTTAGTGGAGCAATGGATACAACTAGCTACAG |
| AGAAGCTGCTTGTTGTCATCTCGCAAAGGCTCTCAATGACTTCAGTAACTCAGGTTCTGATGTTCTTTACCAACCACCACAAACCTCTATC |
| ACCTCAGCTGTTTTGCAGAGTGGTTTTAGAAAAATGGCATTCCCATCTGGTAAAGTTGAGGGTTGTATGGTACAAGTAACTTGTGGTACA |
| ACTACACTTAACGGTCTTTGGCTTGATGACGTAGTTTACTGTCCAAGACATGTGATCTGCACCTCTGAAGACATGCTTAACCCTAATTATG |
| AAGATTTACTCATTCGTAAGTCTAATCATAATTTCTTGGTACAGGCTGGTAATGTTCAACTCAGGGTTATTGGACATTCTATGCAAAATTG |
| TGTACTTAAGCTTAAGGTTGATACAGCCAATCCTAAGACACCTAAGTATAAGTTTGTTCGCATTCAACCAGGACAGACTTTTTCAGTGTTA |
| GCTTGTTACAATGGTTCACCATCTGGTGTTTACCAATGTGCTATGAGGCCCAATTTCACTATTAAGGGTTCATTCCTTAATGGTTCATGTG |
| GTAGTGTTGGTTTTAACATAGATTATGACTGTGTCTCTTTTTGTTACATGCACCATATGGAATTACCAACTGGAGTTCATGCTGGCACAGA |
| CTTAGAAGGTAACTTTTATGGACCTTTTGTTGACAGGCAAACAGCACAAGCAGCTGGTACGGACACAACTATTACAGTTAATGTTTTAGC |
| TTGGTTGTACGCTGCTGTTATAAATGGAGACAGGTGGTTTCTCAATCGATTTACCACAACTCTTAATGACTTTAACCTTGTGGCTATGAAG |
| TACAATTATGAACCTCTAACACAAGACCATGTTGACATACTAGGACCTCTTTCTGCTCAAACTGGAATTGCCGTTTTAGATATGTGCTT |
| CATTAAAAGAATTACTGCAAAATGGTATGAATGGACGTACCATATTGGGTAGTGCTTTATTAGAAGATGAATTTACACCTTTTGATGTTG |
| TTAGACAATGCTCAGGTGTTACTTTCCAAAGTGCAGTGAAAAGAACAATCAAGGGTACACACCACTGGTTGTTACTCACAATTTTGACTT |
| CACTTTTAGTTTTAGTCCAGAGTACTCAATGGTCTTTGTTCTTTTTTTNTATGAAAATGCCTTTTTACCTTTTGCTATGGGTATTATTGCTA |
| TGTCTGCTTTTGCAATGATGTTTGTCAAACATAAGCATGCATTTCTCTGTTTGTTTTTGTTACCTTCTCTTGCCACTGTAGCTTATTTTAATA |
| TGGTCTATATGCCTGCTAGTTGGGTGATGCGTATTATGACATGGTTGGATATGGTTGATACTAGTTTGTCTGGTTTTAAGCTAAAAGACT |
| GTGTTATGTATGCATCAGCTGTAGTGTTACTAATCCTTATGACAGCAAGAACTGTGTATGATGATGGTGCTAGGAGAGTGTGGACACTT |
| ATGAATGTCTTGACACTCGTTTATAAAGTTTATTATGGTAATGCTTTAGATCAAGCCATTTCCATGTGGGCTCTTATAATCTCTGTTACTTC |
| TAACTACTCAGGTGTAGTTACAACTGTCATGTTTTTGGCCAGAGGTATTGTTTTATGTGTGTTGAGTATTGCCCTATTTTCTTCATAACTG |
| GTAATACACTTCAGTGTATAATGCTAGTTTATTGTTTCTTAGGCTATTTTTGTACTTGTTACTTTGGCCTCTTTTGTTTACTCAACCGCTACT |
| TTAGACTGACTCTTGGTGTTTATGATTACTTAGTTTCTACACAGGAGTTTAGATATATGAATTCACAGGGACTACTCCCACCCAA |
| GAATAGCATAGATGCCTTCAAACTCAACATTAAATTGTTGGGTGTTGGTGGCAAACCTTGTATCAAAGTAGCCACTGTACAGTCTAAAAT |
| GTCAGATGTAAAGTGCACATCAGTAGTCTTACTCTCAGTTTTGCAACAACTCAGAGTAGAATCATCATCTAAATTGTGGGCTCAATGTGT |
| CCAGTTACACAATGACATTCTCTTAGCTAAAGATACTACTGAAGCCTTTGAAAAAATGGTTTCACTACTTTCTGTTTTGCTTTCCATGCAGG |
| GTGCTGTAGACATAAACAAGCTTTGTGAAGAAATGCTGGACAACAGGGCAACCTTACAAGCTATAGCCTCAGAGTTTAGTTCCCTTCCAT |

| SEQUENCES |
| --- |
| CATATGCAGCTTTTGCTACTGCTCAAGAAGCTTATGAGCAGGCTGTTGCTAATGGTGATTCTGAAGTTGTTCTTAAAAAGTTGAAGAAGT |
| CTTTGAATGTGGCTAAATCTGAATTTGACCGTGATGCAGCCATGCAACGTAAGTTGGAAAAGATGGCTGATCAAGCTATGACCCAAATG |
| TATAAACAGGCTAGATCTGAGGACAAGAGGGCAAAAGTTACTAGTGCTATGCAGACAATGCTTTTCACTATGCTTAGAAAGTTGGATAA |
| TGATGCACTCAACAACATTATCAACAATGCAAGAGATGGTTGTGTTCCCTTGAACATAATACCTCTTACAACAGCAGCCAAACTAATGGT |
| TGTCATACCAGACTATAACACATATAAAAATACGTGTGATGGTACAACATTTACTTATGCATCAGCATTGTGGGAAATCCAACAGGTTGT |
| AGATGCAGATAGTAAAATTGTTCAACTTAGTGAAATTAGTATGGACAATTCACCTAATTTAGCATGGCCTCTTATTGTAACAGCTTTAAG |
| GGCCAATTCTGCTGTCAAATTACAGAATAATGAGCTTAGTCCTGTTGCACTACGACAGATGTCTTGTGCTGCCGGTACTACACAAACTGC |
| TTGCACTGATGACAATGCGTTAGCTTACTACAACACAACAAAGGGAGGTAGGTTTGTACTTGCACTGTTATCCGATTTACAGGATTTGAA |
| ATGGGCTAGATTCCCTAAGAGTGATGGAACTGGTACTATCTATACAGAACTGGAACCACCTTGTAGGTTTGTTACAGACACACCTAAAG |
| GTCCTAAAGTGAAGTATTTATACTTTATTAAAGGATTAAACAACCTAAATAGAGGTATGGTACTTGGTAGTTTAGCTGCCACAGTACGTC |
| TACAAGCTGGTAATGCAACAGAAGTGCCTGCCAATTCAACTGTATTATCTTTCTGTGCTTTTGCTGTAGATGCTGCTAAAGCTTACAAAGA |
| TTATCTAGCTAGTGGGGGACAACCAATCACTAATTGTGTTAAGATGTTGTGTACACACTGGTACTGGTCAGGCAATAACAGTTACACC |
| GGAAGCCAATATGGATCAAGAATCCTTTGGTGGTGCATCGTGTTGTCTGTACTGCCGTTGCCACATAGATCATCCAAATCCTAAAGGATT |
| TTGTGACTTAAAAGGTAAGTATGTACAAATACCTACAACTTGTGCTAATGACCCTGTGGGTTTTACACTTAAAAACACAGTCTGTACCGTC |
| TGCGGTATGTGGAAAGGTTATGGCTGTAGTTGTGATCAACTCCGCGAACCCATGCTTCAGTCAGCTGATGCACAATCGTTTTTAAACGG |
| GTTTGCGGTGTAAGTGCAGCCCGTCTTACACCGTGCGGCACAGGCACTAGTACTGATGTCGTATACAGGGCTTTTGACATCTACAATGAT |
| AAAGTAGCTGGTTTTGCTAAATTCCTAAAAACTAATTGTTGTCGCTTCCAAGAAAAGGACGAAGATGACAATTTAATTGATTCTTACTTTG |
| TAGTTAAGAGACACACTTTCTCTAACTACCAACATGAAGAAACAATTTATAATTTACTTAAGGATTGTCCAGCTGTTGCTAAACATGACTT |
| CTTTAAGTTTAGAATAGACGGTGACATGGTACCACATATATCACGTCAACGTCTTACTAAATACACAATGGCAGACCTCGTCTATGCTTTA |
| AGGCATTTTGATGAAGGTAATTGTGACACATTAAAAGAAATACTTGTCACATACAATTGTTGTGATGATGATTATTTCAATAAAAAGGAC |
| TGGTATGATTTTGTAGAAAACCCAGATATATTACGCGTATACGCCAACTTAGGTGAACGTGTACGCCAAGCTTTGTTAAAAACAGTACAA |
| TTCTGTGATGCCATGCGAAATGCTGGTATTGTTGGTGTACTGACATTAGATAATCAAGATCTCAATGGTAACTGGTATGATTTCGGTGAT |
| TTCATACAAACCACGCCAGGTAGTGGAGTTCCTGTTGTAGATTCTTATTATTCATTGTTAATGCCTATATTAACCTTGACCAGGGCTTTAA |
| CTGCAGAGTCACATGTTGACACTGACTTAACAAAGCCTTACATTAAGTGGGATTTGTTAAAATATGACTTCACGGAAGAGAGGTTAAAA |
| CTCTTTGACCGTTATTTTAAATATTGGGATCAGACATACCACCCAAATTGTGTTAACTGTTTGGATGACAGATGCATTCTGCATTGTGCAA |
| ACTTTAATGTTTTATTCTCTACAGTGTTCCCACCTACAAGTTTTGGACCACTAGTGAGAAAAATATTTGTTGATGGTGTTCCATTTGTAGTT |
| TCAACTGGATACCACTTCAGAGAGCTAGGTGTTGTACATAATCAGGATGTAAACTTACATAGCTCTAGACTTAGTTTTAAGGAATTACTT |
| GTGTATGCTGCTGACCCTGCTATGCACGCTGCTTCTGGTAATCTATTACTAGATAAACGCACTACGTGCTTTTCAGTAGCTGCACTTACTA |
| ACAATGTTGCTTTTCAAACTGTCAAACCCGGTAATTTTAACAAAGACTTCTATGACTTTGCTGTGTCTAAGGGTTTCTTTAAGGAAGGAAG |
| TTCTGTTGAATTAAAACACTTCTTCTTTGCTCAGGATGGTAATGCTGCTATCAGCGATTATGACTACTATCGTTATAATCTACCAACAATGT |
| GTGATATCAGACAACTACTATTTGTAGTTGAAGTTGTTGATAAGTACTTTGATTGTTACGATGGTGGCTGTATTAATGCTAACCAAGTCAT |
| CGTCAACAACCTAGACAAATCAGCTGGTTTTCCATTTAATAAATGGGGTAAGGCTAGACTTTATTATGATTCAATGAGTTATGAGGATCA |
| AGATGCACTTTTCGCATATACAAAACGTAATGTCATCCCTACTATAACTCAAATGAATCTTAAGTATGCCATTAGTGCAAAGAATAGAGCT |
| CGCACCGTAGCTGGTGTCTCTATCTGTAGTACTATGACCAATAGACAGTTTCATCAAAAATTATTGAAATCAATAGCCGCCACTAGAGGA |
| GCTACTGTAGTAATTGGAACAAGCAAATTCTATGGTGGTTGGCACAACATGTTAAAAACTGTTTATAGTGATGTAGAAACCCTCACCTT |
| ATGGGTTGGGATTATCCTAAATGTGATAGAGCCATGCCTAACATGCTTAGAATTATGGCCTCACTTGTTCTTGCTCGCAAACATACAACG |
| TGTTGTAGCTTGTCACACCGTTTCTATAGATTAGCTAATGAGTGTGCTCAAGTATTGAGTGAAATGGTCATGTGTGGCGGTTCACTATAT |
| GTTAAACCAGGTGGAACCTCATCAGGAGATGCCACAACTGCTTATGCTAATAGTGTTTTTAACATTTGTCAAGCTGTCACGGCCAATGTT |
| AATGCACTTTTATCTACTGATGGTAACAAAATTGCCGATAAGTATGTCCGCAATTTACAACACAGACTTTATGAGTGTCTCTATAGAAATA |

```
GAGATGTTGACACAGACTTTGTGAATGAGTTTTACGCATATTTGCGTAAACATTTCTCAATGATGATACTCTCTGACGATGCTGTTGTGTG

TTTCAATAGCACTTATGCATCTCAAGGTCTAGTGGCTAGCATAAAGAACTTTAAGTCAGTTCTTTATTATCAAACAATGTTTTTATGTCTG

AAGCAAAATGTTGGACTGAGACTGACCTTACTAAAGGACCTCATGAATTTTGCTCTCAACATACAATGCTAGTTAAACAGGGTGATGATT

ATGTGTACCTTCCTTACCCAGATCCATCAAGAATCCTAGGGGCCGGCTGTTTTGTAGATGATATCGTAAAAACAGATGGTACACTTATGA

TTGAACGGTTCGTGTCTTTAGCTATAGATGCTTACCCACTTACTAAACATCCTAATCAGGAGTATGCTGATGTCTTTCATTTGTACTTACAA

TACATAAGAAAGCTACATGATGAGTTAACAGGACACATGTTAGACATGTATTCTGTTATGCTTACTAATGATAACACTTCAAGGTATTGG

GAACCTGAGTTTTATGAGGCTATGTACACACCGCATACAGTCTTACAGGCTGTTGGGGCTTGTGTTCTTTGCAATTCACAGACTTCATTAA

GATGTGGTGCTTGCATACGTAGACCATTCTTATGTTGTAAATGCTGTTACGACCATGTCATATCAACATCACATAAATTAGTCTTGTCTGT

TAATCCGTATGTTTGCAATGCTCCAGGTTGTGATGTCACAGATGTGACTCAACTTTACTTAGGAGGTATGAGCTATTATTGTAAATCACAT

AAACCACCCATTAGTTTTCCATTGTGTGCTAATGGACAAGTTTTTGGTTTATATAAAAATACATGTGTTGGTAGCGATAATGTTACTGACT

TTAATGCAATTGCAACATGTGACTGGACAAATGCTGGTGATTACATTTTAGCTAACACCTGTACTGAAAGACTCAAGCTTTTTGCAGCAG

AAACGCTCAAAGCTACTGAGGAGACATTTAAACTGTCTTATGGTATTGCTACTGTACGTGAAGTGCTGTCTGACAGAGAATTACATCTTT

CATGGGAAGTTGGTAAACCTAGACCACCACTTAACCGAAATTATGTCTTTACTGGTTATCGTGTAACTAAAAACAGTAAAGTACAAATAG

GAGAGTACACCTTTGAAAAAGGTGACTATGGTGATGCTGTTGTTTACCGAGGTACAACAACTTACAAATTAAATGTTGGTGATTATTTTG

TGCTGACATCACATACAGTAATGCCATTAAGTGCACCTACACTAGTGCCACAAGAGCACTATGTTAGAATTACTGGCTTATACCCAACAC

TCAATATCTCAGATGAGTTTTCTAGCAATGTTGCAAATTATCAAAAGGTTGGTATGCAAAAGTATTCTACACTCCAGGGACCACCTGGTA

CTGGTAAGAGTCATTTTGCTATTGGCCTAGCTCTCTACTACCCTTCTGCTCGCATAGTGTATACAGCTTGCTCTCATGCCGCTGTTGATGC

ACTATGTGAGAAGGCATTAAAATATTTGCCTATAGATAAATGTAGTAGAATTATACCTGCACGTGCTCGTGTAGAGTGTTTTGATAAATT

CAAAGTGAATTCAACATTAGAACAGTATGTCTTTTGTACTGTAAATGCATTGCCTGAGACGACAGCAGATATAGTTGTCTTTGATGAAAT

TTCAATGGCCACAAATTATGATTTGAGTGTTGTCAATGCCAGATTACGTGCTAAGCACTATGTGTACATTGGCGACCCTGCTCAATTACCT

GCACCACGCACATTGCTAACTAAGGGCACACTAGAACCAGAATATTTCAATTCAGTGTGTAGACTTATGAAAACTATAGGTCCAGACATG

TTCCTCGGAACTTGTCGGCGTTGTCCTGCTGAAATTGTTGACACTGTGAGTGCTTTGGTTTATGATAATAAGCTTAAAGCACATAAAGAC

AAATCAGCTCAATGCTTTAAAATGTTTTATAAGGGTGTTATCACGCATGATGTTTCATCTGCAATTAACAGGCCACAAATAGGCGTGGTA

AGAGAATTCCTTACACGTAACCCTGCTTGGAGAAAAGCTGTCTTTATTTCACCTTATAATTCACAGAATGCTGTAGCCTCAAAGATTTGG

GACTACCAACTCAAACTGTTGATTCATCACAGGGCTCAGAATATGACTATGTCATATTCACTCAAACCACTGAAACAGCTCACTCTTGTAA

TGTAAACAGATTTAATGTTGCTATTACCAGAGCAAAAGTAGGCATACTTTGCATAATGTCTGATAGAGACCTTTATGACAAGTTGCAATT

TACAAGTCTTGAAATTCCACGTAGGAATGTGGCAACTTTACAAGCTGAAAATGTAACAGGACTCTTTAAAGATTGTAGTAAGGTAATCAC

TGGGTTACATCCTACACAGGCACCTACACACCTCAGTGTTGACACTAAATTCAAAACTGAAGGTTTATGTGTTGACATACCTGGCATACC

TAAGGACATGACCTATAGAAGACTCATCTCTATGATGGGTTTTAAAATGAATTATCAAGTTAATGGTTACCCTAACATGTTTATCACCCGC

GAAGAAGCTATAAGACATGTACGTGCATGGATTGGCTTCGATGTCGAGGGGTGTCATGCTACTAGAGAAGCTGTTGGTACCAATTTACC

TTTACAGCTAGGTTTTTCTACAGGTGTTAACCTAGTTGCTGTACCTACAGGTTATGTTGATACACCTAATAATACAGATTTTTCCAGAGTTA

GTGCTAAACCACCGCCTGGAGATCAATTTAAACACCTCATACCACTTATGTACAAAGGACTTCCTTGGAATGTAGTGCGTATAAAGATTG

TACAAATGTTAAGTGACACACTTAAAAATCTCTCTGACAGAGTCGTATTTGTCTTATGGGCACATGGCTTTGAGTTGACATCTATGAAGT

ATTTTGTGAAAATAGGACCTGAGCGCACCTGTTGTCTATGTGATAGACGTGCCACATGCTTTTCCACTGCTTCAGACACTTATGCCTGTTG

GCATCATTCTATTGGATTTGATTACGTCTATAATCCGTTTATGATTGATGTTCAACAATGGGGTTTTACAGGTAACCTACAAAGCAACCAT

GATCTGTATTGTCAAGTCCATGGTAATGCACATGTAGCTAGTTGTGATGCAATCATGACTAGGTGTCTAGCTGTCCACGAGTGCTTTGTT

AAGCGTGTTGACTGGACTATTGAATATCCTATAATTGGTGATGAACTGAAGATTAATGCGGCTTGTAGAAAGGTTCAACACATGGTTGTT

AAAGCTGCATTATTAGCAGACAAATTCCCAGTTCTTCACGACATTGGTAACCCTAAAGCTATTAAGTGTGTACCTCAAGCTGATGTAGAA
```

| SEQUENCES |
|---|
| TGGAAGTTCTATGATGCACAGCCTTGTAGTGACAAAGCTTATAAAATAGAAGAATTATTCTATTCTTATGCCACACATTCTGACAAATTCA |
| CAGATGGTGTATGCCTATTTTGGAATTGCAATGTCGATAGATATCCTGCTAATTCCATTGTTTGTAGATTTGACACTAGAGTGCTATCTAA |
| CCTTAACTTGCCTGGTTGTGATGGTGGCAGTTTGTATGTAAATAAACATGCATTCCACACACCAGCTTTTGATAAAAGTGCTTTTGTTAAT |
| TTAAAACAATTACCATTTTTCTATTACTCTGACAGTCCATGTGAGTCTCATGGAAAACAAGTAGTGTCAGATATAGATTATGTACCACTAA |
| AGTCTGCTACGTGTATAACACGTTGCAATTTAGGTGGTGCTGTCTGTAGACATCATGCTAATGAGTACAGATTGTATCTCGATGCTTATA |
| ACATGATGATCTCAGCTGGCTTTAGCTTGTGGGTTTACAAACAATTTGATACTTATAACCTCTGGAACACTTTTACAAGACTTCAGAGTTT |
| AGAAAATGTGGCTTTTAATGTTGTAAATAAGGGACACTTTGATGGACAACAGGGTGAAGTACCAGTTTCTATCATTAATAACACTGTTTA |
| CACAAAAGTTGATGGTGTTGATGTAGAATTGTTTGAAAATAAAACAACATTACCTGTTAATGTAGCATTTGAGCTTTGGGCTAAGCGCAA |
| CATTAAACCAGTACCAGAGGTGAAAATACTCAATAATTTGGGTGTGGACATTGCTGCTAATACTGTGATCTGGGACTACAAAAGAGATG |
| CTCCAGCACATATATCTACTATTGGTGTTTGTTCTATGACTGACATAGCCAAGAAACCAACTGAAACGATTTGTGCACCACTCACTGTCTT |
| TTTTGATGGTAGAGTTGATGGTCAAGTAGACTTATTTAGAAATGCCCGTAATGGTGTTCTTATTACAGAAGGTAGTGTTAAAGGTTTACA |
| ACCATCTGTAGGTCCCAAACAAGCTAGTCTTAATGGAGTCACATTAATTGGAGAAGCCGTAAAAACACAGTTCAATTATTATAAGAAAGT |
| TGATGGTGTTGTCCAACAATTACCTGAAACTTACTTTACTCAGAGTAGAAATTTACAAGAATTTAAACCCAGGAGTCAAATGGAAATTGA |
| TTTCTTAGAATTAGCTATGGATGAATTCATTGAACGGTATAAATTAGAAGGCTATGCCTTCGAACATATCGTTTATGGAGATTTTAGTCAT |
| AGTCAGTTAGGTGGTTTACATCTACTGATTGGACTAGCTAAACGTTTTAAGGAATCACCTTTTGAATTAGAAGATTTTATTCCTATGGACA |
| GTACAGTTAAAAACTATTTCATAACAGATGCGCAAACAGGTTCATCTAAGTGTGTGTGTTCTGTTATTGATTATTACTTGATGATTTTGTT |
| GAAATAATAAAATCCCAAGATTTATCTGTAGTTTCTAAGGTTGTCAAAGTGACTATTGACTATACAGAAATTTCATTTATGCTTTGGTGTA |
| AAGATGGCCATGTAGAAACATTTTACCCAAAATTACAATCTAGTCAAGCGTGGCAACCGGGTGTTGCTATGCCTAATCTTTACAAAATGC |
| AAAGAATGCTATTAGAAAAGTGTGACCTTCAAAATTATGGTGATAGTGCAACATTACCTAAAGGCATAATGATGAATGTCGCAAAATAT |
| ACTCAACTGTGTCAATATTTAAACACATTAACATTAGCTGTACCCTATAATATGAGAGTTATACATTTTGGTGCTGGTTCTGATAAAGGAG |
| TTGCACCAGGTACAGCTGTTTTAAGACAGTGGTTGCCTACGGGTACGCTGCTTGTCGATTCAGATCTTAATGACTTTGTCTCTGATGCAG |
| ATTCAACTTTGATTGGTGATTGTGCAACTGTACATACAGCTAATAAATGGGATCTCATTATTAGTGATATGTACGACCCTAAGACTAAAA |
| ATGTTACAAAAGAAAATGACTCTAAAGAGGGTTTTTTCACTTACATTTGTGGGTTTATACAACAAAAGCTAGCTCTTGGAGGTTCCGTGG |
| CTATAAAGATAACAGAACATTCTTGGAATGCTGATCTTTATAAGCTCATGGGACACTTCGCATGGTGGACAGCCTTTGTTACTAATGTGA |
| ATGCGTCATCATCTGAAGCATTTTTAATTGGATGTAATTATCTTGGCAAACCACGCGAACAAATAGATGGTTATGTCATGCATGCAAATT |
| ACATATTTTGGAGGAATACAAATCCAATTCAGTTGTCTTCCTATTCTTTATTTGACATGAGTAAATTTCCCCTTAAATTAAGGGGTACTGCT |
| GTTATGTCTTTAAAAGAAGGTCAAATCAATGATATGATTTATCTCTTCTTAGTAAAGGTAGACTTATAATTAGAGAAAACAACAGAGTT |
| GTTATTTCTAGTGATGTTCTTGTTAACAACTAAACGAACAATGTTTGTTTTTCTTGTTTTATTGCCACTAGTCTCTAGTCAGTGTGTTAATCT |
| TACAACCAGAACTCAATTACCCCCTGCATACACTAATTCTTTCACACGTGGTGTTTATTACCCTGACAAAGTTTTCAGATCCTCAGTTTTAC |
| ATTCAACTCAGGACTTGTTCTTACCTTTCTTTTCCAATGTTACTTGGTTCCATGCTATACATGTCTCTGGGACCAATGGTACTAAGAGGTTT |
| GATAACCCTGTCCTACCATTTAATGATGGTGTTTATTTTGCTTCCACTGAGAAGTCTAACATAATAAGAGGCTGGATTTTGGTACTACTT |
| TAGATTCGAAGACCCAGTCCCTACTTATTGTTAATAACGCTACTAATGTTGTTATTAAAGTCTGTGAATTTCAATTTTGTAATGATCCATTT |
| TTGGGTGTTTATTACCACAAAAACAACAAAAGTTGGATGGAAAGTGAGTTCAGAGTTTATTCTAGTGCGAATAATTGCACTTTTGAATAT |
| GTCTCTCAGCCTTTTCTTATGGACCTTGAAGGAAAACAGGGTAATTTCAAAAATCTTAGGGAATTTGTGTTTAAGAATATTGATGGTTATT |
| TTAAAATATATTCTAAGCACACGCCTATTAATTTAGTGCGTGATCTCCCTCAGGGTTTTTCGGCTTTAGAACCATTGGTAGATTTGCCAAT |
| AGGTATTAACATCACTAGGTTTCAAACTTTACTTGCTTTACATAGAAGTTATTTGACTCCTGGTGATTCTTCTTCAGGTTGGACAGCTGGT |
| GCTGCAGCTTATTATGTGGGTTATCTTCAACCTAGGACTTTTCTATTAAAATATAATGAAAATGGAACCATTACAGATGCTGTAGACTGTG |
| CACTTGACCCTCTCTCAGAAACAAAGTGTACGTTGAAATCCTTCACTGTAGAAAAGGAATCTATCAAACTTCTAACTTTAGAGTCCAACC |
| AACAGAATCTATTGTTAGATTTCCTAATATTACAAACTTGTGCCCTTTTGGTGAAGTTTTTAACGCCACCAGATTTGCATCTGTTTATGCTT |

-continued

| SEQUENCES |
|---|
| GGAACAGGAAGAGAATCAGCAACTGTGTTGCTGATTATTCTGTCCTATATAATTCCGCATCATTTTCCACTTTTAAGTGTTATGGAGTGTC |
| TCCTACTAAATTAAATGATCTCTGCTTTACTAATGTCTATGCAGATTCATTTGTAATTAGAGGTGATGAAGTCAGACAAATCGCTCCAGGG |
| CAAACTGGAAAGATTGCTGATTATAATTATAAATTACCAGATGATTTTACAGGCTGCGTTATAGCTTGGAATTCTAACAATCTTGATTCTA |
| AGGTTGGTGGTAATTATAATTACCTGTATAGATTGTTTAGGAAGTCTAATCTCAAACCTTTTGAGAGAGATATTTCAACTGAAATCTATCA |
| GGCCGGTAGCACACCTTGTAATGGTGTTGAAGGTTTTAATTGTTACTTTCCTTTACAATCATATGGTTTCCAACCCACTAATGGTGTTGGT |
| TACCAACCATACAGAGTAGTAGTACTTTCTTTTGAACTTCTACATGCACCAGCAACTGTTTGTGGACCTAAAAAGTCTACTAATTTGGTTA |
| AAAACAAATGTGTCAATTTCAACTTCAATGGTTTAACAGGCACAGGTGTTCTTACTGAGTCTAACAAAAAGTTTCTGCCTTTCCAACAATT |
| TGGCAGAGACATTGCTGACACTACTGATGCTGTCCGTGATCCACAGACACTTGAGATTCTTGACATTACACCATGTTCTTTTGGTGGTGTC |
| AGTGTTATAACACCAGGAACAAATACTTCTAACCAGGTTGCTGTTCTTTATCAGGATGTTAACTGCACAGAAGTCCCTGTTGCTATTCATG |
| CAGATCAACTTACTCCTACTTGGCGTGTTTATTCTACAGGTTCTAATGTTTTCAAACACGTGCAGGCTGTTTAATAGGGGCTGAACATGT |
| CAACAACTCATATGAGTGTGACATACCCATTGGTGCAGGTATATGCGCTAGTTATCAGACTCAGACTAATTCTCCTCGGCGGGCACGTAG |
| TGTAGCTAGTCAATCCATCATTGCCTACACTATGTCACTTGGTGCAGAAAATTCAGTTGCTTACTCTAATAACTCTATTGCCATACCCACAA |
| ATTTTACTATTAGTGTTACCACAGAAATTCTACCAGTGTCTATGACCAAGACATCAGTAGATTGTACAATGTACATTTGTGGTGATTCAAC |
| TGAATGCAGCAATCTTTTGTTGCAATATGGCAGTTTTTGTACACAATTAAACCGTGCTTTAACTGGAATAGCTGTTGAACAAGACAAAAA |
| CACCCAAGAAGTTTTTGCACAAGTCAAACAAATTTACAAAACACCACCAATTAAAGATTTTGGTGGTTTTAATTTTTCACAAATATTACCA |
| GATCCATCAAAACCAAGCAAGAGGTCATTTATTGAAGATCTACTTTTCAACAAAGTGACACTTGCAGATGCTGGCTTCATCAAACAATAT |
| GGTGATTGCCTTGGTGATATTGCTGCTAGAGACCTCATTTGTGCACAAAAGTTTAACGGCCTTACTGTTTTGCCACCTTTGCTCACAGATG |
| AAATGATTGCTCAATACACTTCTGCACTGTTAGCGGGTACAATCACTTCTGGTTGGACCTTTGGTGCAGGTGCTGCATTACAAATACCATT |
| TGCTATGCAAATGGCTTATAGGTTTAATGGTATTGGAGTTACACAGAATGTTCTCTATGAGAACCAAAAATTGATTGCCAACCAATTTAA |
| TAGTGCTATTGGCAAAATTCAAGACTCACTTTCTTCCACAGCAAGTGCACTTGGAAAACTTCAAGATGTGGTCAACCAAAATGCACAAGC |
| TTTAAACACGCTTGTTAAACAACTTAGCTCCAATTTTGGTGCAATTTCAAGTGTTTTAAATGATATCCTTTCACGTCTTGACAAAGTTGAG |
| GCTGAAGTGCAAATTGATAGGTTGATCACAGGCAGACTTCAAAGTTTGCAGACATATGTGACTCAACAATTAATTAGAGCTGCAGAAAT |
| CAGAGCTTCTGCTAATCTTGCTGCTACTAAAATGTCAGAGTGTGTACTTGGACAATCAAAAAGAGTTGATTTTTGTGGAAAGGGCTATCA |
| TCTTATGTCCTTCCCTCAGTCAGCACCTCATGGTGTAGTCTTCTTGCATGTGACTTATGTCCCTGCACAAGAAAAGAACTTCACAACTGCTC |
| CTGCCATTTGTCATGATGGAAAAGCACACTTTCCTCGTGAAGGTGTCTTTGTTTCAAATGGCACACACTGGTTTGTAACACAAAGGAATT |
| TTTATGAACCACAAATCATTACTACAGACAACACATTTGTGTCTGGTAACTGTGATGTTGTAATAGGAATTGTCAACAACACAGTTTATGA |
| TCCTTTGCAACCTGAATTAGACTCATTCAAGGAGGAGTTAGATAAATATTTTAAGAATCATACATCACCAGATGTTGATTTAGGTGACATC |
| TCTGGCATTAATGCTTCAGTTGTAAACATTCAAAAAGAAATTGACCGCCTCAATGAGGTTGCCAAGAATTTAAATGAATCTCTCATCGATC |
| TCCAAGAACTTGGAAAGTATGAGCAGTATATAAAATGGCCATGGTACATTTGGCTAGGTTTTATAGCTGGCTTGATTGCCATAGTAATG |
| GTGACAATTATGCTTTGCTGTATGACCAGTTGCTGTAGTTGTCTCAAGGGCTGTTGTTCTTGTGGATCCTGCTGCAAATTTGATGAAGAC |
| GACTCTGAGCCAGTGCTCAAAGGAGTCAAATTACATTACACATAAACGAACTTATGGATTTGTTTATGAGAATCTTCACAATTGGAACTG |
| TAACTTTGAAGCAAGGTGAAATCAAGGATGCTACTCCTTCAGATTTTGTTCGCGCTACTGCAACGATACCGATACAAGCCTCACTCCCTTT |
| CGGATGGCTTATTGTTGGCGTTGCACTTCTTGCTGTTTTTCAGAGCGCTTCCAAAATCATAACCCTCAAAAGAGATGGCAACTAGCACT |
| CTCCAAGGGTGTTCACTTTGTTGCAACTTGCTGTTGTTGTTTGTAACAGTTTACTCACACCTTTTGCTCGTTGCTGCTGGCCTTGAAGCCC |
| CTTTTCTCTATCTTTATGCTTTAGTCTACTTCTTGCAGAGTATAAACTTTGTAAGAATAATAATGAGGCTTTGGCTTTGCTGGAAATGCCGT |
| TCCAAAAACCCATTACTTTATGATGCCAACTATTTTCTTTGCTGGCATACTAATTGTTACGACTATTGTATACCTTACAATAGTGTAACTTCT |
| TCAATTGTCATTACTTCAGGTGATGGCACAACAAGTCCTATTTCTGAACATGACTACCAGATTGGTGGTTATACTGAAAAATGGGAATCT |
| GGAGTAAAAGACTGTGTTGTATTACACAGTTACTTCACTTCAGACTATTACCAGCTGTACTCAACTCAATTGAGTACAGACACTGGTGTT |

| SEQUENCES |
| --- |
| GAACATGTTACCTTCTTCATCTACAATAAAATTGTTGATGAGCCTGAAGAACATGTCCAAATTCACACAATCGACGTTTCATCCGGAGTTG |
| TTAATCCAGTAATGGAACCAATTTATGATGAACCGACGACGACTACTAGCGTGCCTTTGTAAGCACAAGCTGATGAGTACGAACTTATGT |
| ACTCATTCGTTTCGGAAGAGACAGGTACGTTAATAGTTAATAGCGTACTTCTTTTTCTTGCTTTCGTGGTATTCTTGCTAGTTACACTAGCC |
| ATCCTTACTGCGCTTCGATTGTGTGCGTACTGCTGCAATATTGTTAACGTGAGTCTTGTAAAACCTTCTTTTTACGTTTACTCTCGTGTTAA |
| AAATCTGAATTCTTCTAGAGTTCCTGATCTTCTGGTCTAAACGAACTAAATATTATATTAGTTTTTCTGTTTGGAACTTTAATTTTAGCCAT |
| GGCAGATTCCAACGGTACTATTACCGTTGAAGAGCTTAAAAAGCTCCTTGAACAATGGAACCTAGTAATAGGTTTCCTATTCCTTACATG |
| GATTTGTCTTCTACAATTTGCCTATGCCAACAGGAATAGGTTTTTGTATATAATTAAGTTAATTTTCCTCTGGCTGTTATGGCCAGTAACTT |
| TAGCTTGTTTTGTGCTTGCTGCTGTTTACAGAATAAATTGGATCACCGGTGGAATTGCTATCGCAATGGCTTGTCTTGTAGGCTTGATGTG |
| GCTCAGCTACTTCATTGCTTCTTTCAGACTGTTTGCGCGTACGCGTTCCATGTGGTCATTCAATCCAGAAACTAACATTCTTCTCAACGTGC |
| CACTCCATGGCACTATTCTGACCAGACCGCTTCTAGAAAGTGAACTCGTAATCGGAGCTGTGATCCTTCGTGGACATCTTCGTATTGCTG |
| GACACCATCTAGGACGCTGTGACATCAAGGACCTGCCTAAAGAAATCACTGTTGCTACATCACGAACGCTTTCTTATTACAAATTGGGAG |
| CTTCGCAGCGTGTAGCAGGTGACTCAGGTTTTGCTGCATACAGTCGCTACAGGATTGGCAACTATAAATTAAACACAGACCATTCCAGTA |
| GCAGTGACAATATTGCTTTGCTTGTACAGTAAGTGACAACAGATGTTTCATCTCGTTGACTTTCAGGTTACTATAGCAGAGATATTACTAA |
| TTATTATGAGGACTTTTAAAGTTTCCATTTGGAATCTTGATTACATCATAAACCTCATAATTAAAAATTTATCTAAGTCACTAACTGAGAAT |
| AAATATTCTCAATTAGATGAAGAGCAACCAATGGAGATTGATTAAACGAACATGAAAATTATTCTTTTCTTGGCACTGATAACACTCGCT |
| ACTTGTGAGCTTTATCACTACCAAGAGTGTGTTAGAGGTACAACAGTACTTTTAAAAGAACCTTGCTCTTCTGGAACATACGAGGGCAAT |
| TCACCATTTCATCCTCTAGCTGATAACAAATTTGCACTGACTTGCTTTAGCACTCAATTTGCTTTTGCTTGTCCTGACGGCGTAAAACACGT |
| CTATCAGTTACGTGCCAGATCAGTTTCACCTAAACTGTTCATCAGACAAGAGGAAGTTCAAGAACTTTACTCTCCAATTTTTCTTATTGTTG |
| CGGCAATAGTGTTTATAACACTTTGCTTCACACTCAAAAGAAAGACAGAATGATTGAACTTTCATTAATTGACTTCTATTTGTGCTTTTTA |
| GCCTTTCTGCTATTCCTTGTTTTAATTATGCTTATTATCTTTTGGTTCTCACTTGAACTGCAAGATCATAATGAAACTTGTCACGCCTAAACG |
| AACATGAAATTTCTTGTTTTCTTAGGAATCATCACAACTGTAGCTGCATTTCACCAAGAATGTAGTTTACAGTCATGTACTCAACATCAAC |
| CATATGTAGTTGATGACCCGTGTCCTATTCACTTCTATTCTAAATGGTATATTAGAGTAGGAGCTAGAAAATCAGCACCTTTAATTGAATT |
| GTGCGTGGATGAGGCTGGTTCTAAATCACCCATTCAGTACATCGATATCGGTAATTATACAGTTTCCTGTTTACCTTTTACAATTAATTGC |
| CAGGAACCTAAATTGGGTAGTCTTGTAGTGCGTTGTTCGTTCTATGAAGACTTTTTAGAGTATCATGACGTTCGTGTTGTTTTAGATTTCA |
| TCTAAACGAACAAACTAAAATGTCTGATAATGGACCCCAAAATCAGCGAAATGCACCCCGCATTACGTTTGGTGGACCCTCAGATTCAAC |
| TGGCAGTAACCAGAATGGAGAACGCAGTGGGGCGCGATCAAAACAACGTCGGCCCCAAGGTTTACCCAATAATACTGCGTCTTGGTTC |
| ACCGCTCTCACTCAACATGGCAAGGAAGACCTTAAATTCCCTCGAGGACAAGGCGTTCCAATTAACACCAATAGCAGTCCAGATGACCA |
| AATTGGCTACTACCGAAGAGCTACCAGACGAATTCGTGGTGGTGACGGTAAAATGAAAGATCTCAGTCCAAGATGGTATTTCTACTACC |
| TAGGAACTGGGCCAGAAGCTGGACTTCCCTATGGTGCTAACAAAGACGGCATCATATGGGTTGCAACTGAGGGAGCCTTGAATACACC |
| AAAAGATCACATTGGCACCCGCAATCCTGCTAACAATGCTGCAATCGTGCTACAACTTCCTCAAGGAACAACATTGCCAAAAGGCTTCTA |
| CGCAGAAGGGAGCAGAGGCGGCAGTCAAGCCTCTTCTCGTTCCTCATCACGTAGTCGCAACAGTTCAAGAAATTCAACTCCAGGCAGCA |
| GTAGGGGAACTTCTCCTGCTAGAATGGCTGGCAATGGCGGTGATGCTGCTCTTGCTTTGCTGCTGCTTGACAGATTGAACCAGCTTGAG |
| AGCAAAATGTCTGGTAAAGGCCAACAACAACAAGGCCAAACTGTCACTAAGAAATCTGCTGCTGAGGCTTCTAAGAAGCCTCGGCAAA |
| AACGTACTGCCACTAAAGCATACAATGTAACACAAGCTTTCGGCAGACGTGGTCCAGAACAAACCCAAGGAAATTTTGGGGACCAGGA |
| ACTAATCAGACAAGGAACTGATTACAAACATTGGCCGCAAATTGCACAATTTGCCCCCAGCGCTTCAGCGTTCTTCGGAATGTCGCGCAT |
| TGGCATGGAAGTCACACCTTCGGGAACGTGGTTGACCTACACAGGTGCCATCAAATTGGATGACAAAGATCCAAATTTCAAAGATCAAG |
| TCATTTTGCTGAATAAGCATATTGACGCATACAAAACATTCCCACCAACAGAGCCTAAAAAGGACAAAAAGAAGAAGGCTGATGAAACT |
| CAAGCCTTACCGCAGAGACAGAAGAAACAGCAAACTGTGACTCTTCTTCCTGCTGCAGATTTGGATGATTTCTCCAAACAATTGCAACAA |
| TCCATGAGCAGTGCTGACTCAACTCAGGCCTAAACTCATGCAGACCACACAAGGCAGATGGGCTATATAAACGTTTTCGCTTTTCCGTTT |

| SEQUENCES |
|---|
| ACGATATATAGTCTACTCTTGTGCAGAATGAATTCTCGTAACTACATAGCACAAGTAGATGTAGTTAACTTTAATCTCACATAGCAATCTT |
| TAATCAGTGTGTAACATTAGGGAGGACTTGAAAGAGCCACCACATTTTCACCGAGGCCACGCGGAGTACGATCGAGTGTACAGTGAAC |
| AATGCTAGGGAGAGCTGCCTATATGGAAGAGCCCTAATGTGTAAAATTAATTTTAGTAGTGCTATCCCCATGTGATTTTAATAGCTTCTT |
| AGGAGAAT |
| >Severe acute respiratory syndrome coronavirus 2 orf1ab polyprotein of isolate hCoV-19/Italy/ INMI1-isI/2020 (Genbank Acc. No: QIA98553) SEQ ID NO: 10 |
| MESLVPGFNEKTHVQLSLPVLQVRDVLVRGFGDSVEEVLSEARQHLKDGTCGLVEVEKGVLPQLEQPYVFIKRSDARTAPHGHVMVELVAELE |
| GIQYGRSGETLGVLVPHVGEIPVAYRKYLLRKNGNKGAGGHSYGADLKSFDLGDELGTDPYEDFQENWNTKHSSGVTRELMRELNGGAYTRY |
| VDNNFCGPDGYPLECIKDLLARAGKASCTLSEQLDFIDTKRGVYCCREHEHEIAWYTERSEKSYELQTPFEIKLAKKFDTFNGECPNFVFPLNSIIK |
| TIQPRVEKKKLDGFMGRIRSVYPVASPNECNQMCLSTLMKCDHCGETSWQTGDFVKATCEFCGTENLTKEGATTCGYLPQNAVVKIYCPACH |
| NSEVGPEHSLAEYHNESGLKTILRKGGRTIAFGGCVFSYVGCHNKCAYWVPRASANIGCNHTGVVGEGSEGLNDNLLEILQKEKVNINIVGDFK |
| LNEEIAIILASFSASTSAFVETVKGLDYKAFKQIVESCGNFKVTKGKAKKGAWNIGEQKSILSPLYAFASEAARVVRSIFSRTLETAQNSVRVLQKA |
| AITILDGISQYSLRLIDAMMFTSDLATNNLVVMAYITGGVVQLTSQWLTNIFGTVYEKLKPVLDWLEEKFKEGVEFLRDGWEIVKFISTCACEIV |
| GGQIVTCAKEIKESVQTFFKLVNKFLALCADSIIIGGAKLKALNLGETFVTHSKGLYRKCVKSREETGLLMPLKAPKEIIFLEGETLPTEVVLTEEVVLK |
| TGDLQPLEQPTSEAVEAPLVGTPVCINGLMLLEIKDTEKYCALAPNMMVTNNTFTLKGGAPTKVTFGDDTVIEVQGYKSVNITFELDERIDKVL |
| NEKCSAYTVELGTEVNEFACVVADAVIKTLQPVSELLTPLGIDLDEWSMATYYLFDESGEFKLASHMYCSFYPPDEDEEEGDCEEEEFEPSTQYE |
| YGTEDDYQGKPLEFGATSAALQPEEEQEEDWLDDDSQQTVGQQDGSEDNQTTTIQTIVEVQPQLEMELTPVVQTIEVNSFSGYLKLTDNVYI |
| KNADIVEEAKKVKPTVVVNAANVYLKHGGGVAGALNKATNNAMQVESDDYIATNGPLKVGGSCVLSGHNLAKHCLHVVGPNVNKGEDIQL |
| LKSAYENFNQHEVLLAPLLSAGIFGADPIHSLRVCVDTVRTNVYLAVFDKNLYDKLVSSFLEMKSEKQVEQKIAEIPKEEVKPFITESKPSVEQRKQ |
| DDKKIKACVEEVTTTLEETKFLTENLLLYIDINGNLHPDSATLVSDIDITFLKKDAPYIVGDVVQEGVLTAVVIPTKKAGGTTEMLAKALRKVPTDN |
| YITTYPGQGLNGYTVEEAKTVLKKCKSAFYILPSIISNEKQEILGTVSWNLREMLAHAEETRKLMPVCVETKAIVSTIQRKYKGIKIQEGVVDYGAR |
| FYFYTSKTTVASLINTLNDLNETLVTMPLGYVTHGLNLEEAARYMRSLKVPATVSVSSPDAVTAYNGYLTSSSKTPEEHFIETISLAGSYKDWSYS |
| GQSTQLGIEFLKRGDKSVYYTSNPTTFHLDGEVITFDNLKTLLSLREVRTIKVFTTVDNINLHTQVVDMSMTYGQQFGPTYLDGADVTKIKPHNS |
| HEGKTFYVLPNDDTLRVEAFEYYHTTDPSFLGRYMSALNHTKKWKYPQVNGLTSIKWADNNCYLATALLTLQQIELKFNPPALQDAYYRARAG |
| EAANFCALILAYCNKTVGELGDVRETMSYLFQHANLDSCKRYLNYVCKTCGQQQTTLKGVEAVMYMGTLSYEQFKKGVQIPCTCGKQATKYL |
| VQQESPFVMMSAPPAQYELKHGTFTCASEYTGNYQCGHYKHITSKETLYCIDGALLTKSSEYKGPITDVFYKENSYTTTIKPVTYKLDGVVCTEID |
| PKLDNYYKKDNSYFTEQPIDLVPNQPYPNASFDNFKFVCDNIKFADDLNQLTGYKKPASRELKVTFFPPDLNGDVVAIDYKHYTPSFKKGAKLLHK |
| PIVWHVNNATNKATYKPNTWCIRCLWSTKPVETSNSFDVLKSEDAQGMDNLACEDLKPVSEEVVENPTIQKDVLECNVKTTEVVGDIILKPAN |
| NSLKITEEVGHTDLMAAYVDNSSLTIKKPNELSRVLGLKTLATHGLAAVNSVPWDTIANYAKPFLNKVVSTTTNIVTRCLNRVCTNYMPYFFTLL |
| LQLCTFTRSTNSRIKASMPTTIAKNTVKSVGKFCLEASFNYLKSPNFSKLINIIIWFLLLSVCLGSLIYSTAALGVLMSNLGMPSYCTGYREGYLNST |
| NVTIATYCTGSIPCSVCLSGLDSLDTYPSLETIQITISSFKWDLTAFGLVAEWFLAYILFTRFFYYLGLAAIMQLFFSYFAVHFISNSWLMWLIINLV |
| QMAPISAMVRMYIFFASFYYVWKSYVHVVDGCNSSTCMMCYKRNRATRVECTTIVNGVRRSFYVYANGGKGFCKLHNWNCVNCDTFCAG |
| STFISDEVARDLSLQFKRPINPTDQSSYIVDSVTVKNGSIHLYFDKAGQKTYERHSLSHFVNLDNLRANNTKGSLPINVIVFDGKSKCEESSAKSAS |
| VYYSQLMCQPILLLDQALVSDVGDSAEVAVKMFDAYVNTFSSTFNVPMEKLKTLVATAEAELAKNVSLDNVLSTFISAARQGFVDSDVETKDV |
| VECLKLSHQSDIEVTGDSCNNYMLTYNKVENMTPRDLGACIDCSARHINAQVAKSHNIALIWNVKDFMSLSEQLRKQIRSAAKKNNLPFKLTC |
| ATTRQVVNVVTTKIALKGGKIVNNWLKQLIKVTLVFLFVAAIFYLITPVHVMSKHTDFSSEIIGYKAIDGGVTRDIASTDTCFANKHADFDTWFS |
| QRGGSYTNDKACPLIAAVITREVGFVVPGLPGTILRTTNGDFLHFLPRVFSAVGNICYTPSKLIEYTDFATSACVLAAECTIFKDASGKPVPYCYDT |
| NVLEGSVAYESLRPDTRYVLMDGSIIQFPNTYLEGSVRVVTTFDSEYCRHGTCERSEAGVCVSTSGRWVLNNDYYRSLPGVFCGVDAVNLLTN |
| MFTPLIQPIGALDISASIVAGGIVAIVVTCLAYYFMRFRRAFGEYSHVVAFNTLLFLMSFTVLCLTPVYSFLPGVYSVIYLYLTFYLTNDVSFLAHIQ |

| SEQUENCES |
|---|
| WMVMFTPLVPFWITIAYIICISTKHFYWFFSNYLKRRVVFNGVSFSTFEEAALCTFLLNKEMYLKLRSDVLLPLTQYNRYLALYNKYKYFSGAMD |
| TTSYREAACCHLAKALNDFSNSGSDVLYQPPQTSITSAVLQSGFRKMAFPSGKVEGCMVQVTCGTTTLNGLWLDDVVYCPRHVICTSEDMLN |
| PNYEDLLIRKSNHNFLVQAGNVQLRVIGHSMQNCVLKLKVDTANPKTPKYKFVRIQPGQTFSVLACYNGSPSGVYQCAMRPNFTIKGSFLNGS |
| CGSVGFNIDYDCVSFCYMHHMELPTGVHAGTDLEGNFYGPFVDRQTAQAAGTDTTITVNVLAWLYAAVINGDRWFLNRFTTTLNDFNLVA |
| MKYNYEPLTQDHVDILGPLSAQTGIAVLDMCASLKELLQNGMNGRTILGSALLEDEFTPFDVVRQCSGVTFQSAVKRTIKGTHHWLLLTILTSL |
| LVLVQSTQWSLFFFXYENAFLPFAMGIIAMSAFAMMFVKHKHAFLCLFLLPSLATVAYFNMVYMPASWVMRIMTWLDMVDTSLSGFKLKD |
| CVMYASAVVLLILMTARTVYDDGARRVWTLMNVLTLVYKVYYGNALDQAISMWALIISVTSNYSGVVTTVMFLARGIVFMCVEYCPIFFITGN |
| TLQCIMLVYCFLGYFCTCYFGLFCLLNRYFRLTLGVYDYLVSTQEFRYMNSQGLLPPKNSIDAFKLNIKLLGVGGKPCIKVATVQSKMSDVKCTSV |
| VLLSVLQQLRVESSSKLWAQCVQLHNDILLAKDTTEAFEKMVSLLSVLLSMQGAVDINKLCEEMLDNRATLQAIASEFSSLPSYAAFATAQEAY |
| EQAVANGDSEVVLKKLKKSLNVAKSEFDRDAAMQRKLEKMADQAMTQMYKQARSEDKRAKVTSAMQTMLFTMLRKLDNDALNNIINNA |
| RDGCVPLNIIPLTTAAKLMVVIPDYNTYKNTCDGTTFTYASALWEIQQVVDADSKIVQLSEISMDNSPNLAWPLIVTALRANSAVKLQNNELSP |
| VALRQMSCAAGTTQTACTDDNALAYYNTTKGGRFVLALLSDLQDLKWARFPKSDGTGTIYTELEPPCRFVTDTPKGPKVKYLYFIKGLNNLNR |
| GMVLGSLAATVRLQAGNATEVPANSTVLSFCAFAVDAAKAYKDYLASGGQPITNCVKMLCTHTGTGQAITVTPEANMDQESFGGASCCLYC |
| RCHIDHPNPKGFCDLKGKYVQIPTTCANDPVGFTLKNTVCTVCGMWKGYGCSCDQLREPMLQSADAQSFLNRVCGVSAARLTPCGTGTSTD |
| VVYRAFDIYNDKVAGFAKFLKTNCCRFQEKDEDDNLIDSYFVVKRHTFSNYQHEETIYNLLKDCPAVAKHDFFKFRIDGDMVPHISRQRLTKYT |
| MADLVYALRHFDEGNCDTLKEILVTYNCCDDDYFNKKDWYDFVENPDILRVYANLGERVRQALLKTVQFCDAMRNAGIVGVLTLDNQDLNG |
| NWYDFGDFIQTTPGSGVPVVDSYYSLLMPILTLTRALTAESHVDTDLTKPYIKWDLLKYDFTEERLKLFDRYFKYWDQTYHPNCVNCLDDRCIL |
| HCANFNVLFSTVFPPTSFGPLVRKIFVDGVPFVVSTGYHFRELGVVHNQDVNLHSSRLSFKELLVYAADPAMHAASGNLLLDKRTTCFSVAALT |
| NNVAFQTVKPGNFNKDFYDFAVSKGFFKEGSSVELKHFFFAQDGNAAISDYDYYRYNLPTMCDIRQLLFVVEVVDKYFDCYDGGCINANQVIV |
| NNLDKSAGFPFNKWGKARLYYDSMSYEDQDALFAYTKRNVIPTITQMNLKYAISAKNRARTVAGVSICSTMTNRQFHQKLLKSIAATRGATVV |
| IGTSKFYGGWHNMLKTVYSDVENPHLMGWDYPKCDRAMPNMLRIMASLVLARKHTTCCSLSHRFYRLANECAQVLSEMVMCGGSLYVKP |
| GGTSSGDATTAYANSVFNICQAVTANVNALLSTDGNKIADKYVRNLQHRLYECLYRNRDVDTDFVNEFYAYLRKHFSMMILSDDAVVCFNST |
| YASQGLVASIKNFKSVLYYQNNVFMSEAKCWTETDLTKGPHEFCSQHTMLVKQGDDYVYLPYPDPSRILGAGCFVDDIVKTDGTLMIERFVSL |
| AIDAYPLTKHPNQEYADVFHLYLQYIRKLHDELTGHMLDMYSVMLTNDNTSRYWEPEFYEAMYTPHTVLQAVGACVLCNSQTSLRCGACIRR |
| PFLCCKCCYDHVISTSHKLVLSVNPYVCNAPGCDVTDVTQLYLGGMSYYCKSHKPPISFPLCANGQVFGLYKNTCVGSDNVTDFNAIATCDWT |
| NAGDYILANTCTERLKLFAAETLKATEETFKLSYGIATVREVLSDRELHLSWEVGKPRPPLNRNYVFTGYRVTKNSKVQIGEYTFEKGDYGDAVV |
| YRGTTTYKLNVGDYFVLTSHTVMPLSAPTLVPQEHYVRITGLYPTLNISDEFSSNVANYQKVGMQKYSTLQGPPGTGKSHFAIGLALYYPSARIV |
| YTACSHAAVDALCEKALKYLPIDKCSRIIPARARVECFDKFKVNSTLEQYVFCTVNALPETTADIVVFDEISMATNYDLSVVNARLRAKHYVYIGD |
| PAQLPAPRTLLTKGTLEPEYFNSVCRLMKTIGPDMFLGTCRRCPAEIVDTVSALVYDNKLKAHKDKSAQCFKMFYKGVITHDVSSAINRPQIGV |
| VREFLTRNPAWRKAVFISPYNSQNAVASKILGLPTQTVDSSQGSEYDYVIFTQTTETAHSCNVNRFNVAITRAKVGILCIMSDRDLYDKLQFTSL |
| EIPRRNVATLQAENVTGLFKDCSKVITGLHPTQAPTHLSVDTKFKTEGLCVDIPGIPKDMTYRRLISMMGFKMNYQVNGYPNMFITREEAIRH |
| VRAWIGFDVEGCHATREAVGTNLPLQLGFSTGVNLVAVPTGYVDTPNNTDFSRVSAKPPPGDQFKHLIPLMYKGLPWNVVRIKIVQMLSDTL |
| KNLSDRVVFVLWAHGFELTSMKYFVKIGPERTCCLCDRRATCFSTASDTYACWHHSIGFDYVYNPFMIDVQQWGFTGNLQSNHDLYCQVHG |
| NAHVASCDAIMTRCLAVHECFVKRVDWTIEYPIIGDELKINAACRKVQHMVVKAALLADKFPVLHDIGNPKAIKCVPQADVEWKFYDAQPCS |
| DKAYKIEELFYSYATHSDKFTDGVCLFWNCNVDRYPANSIVCRFDTRVLSNLNLPGCDGGSLYVNKHAFHTPAFDKSAFVNLKQLPFFYYSDSP |
| CESHGKQVVSDIDYVPLKSATCITRCNLGGAVCRHHANEYRLYLDAYNMMISAGFSLWVYKQFDTYNLWNTFTRLQSLENVAFNVVNKGHF |
| DGQQGEVPVSIINNTVYTKVDGVDVELFENKTTLPVNVAFELWAKRNIKPVPEVKILNNLGVDIAANTVIWDYKRDAPAHISTIGVCSMTDIAK |
| KPTETICAPLTVFFDGRVDGQVDLFRNARNGVLITEGSVKGLQPSVGPKQASLNGVTLIGEAVKTQFNYYKKVDGVVQQLPETYFTQSRNLQE |

| SEQUENCES |
|---|
| FKPRSQMEIDFLELAMDEFIERYKLEGYAFEHIVYGDFSHSQLGGLHLLIGLAKRFKESPFELEDFIPMDSTVKNYFITDAQTGSSKCVCSVIDLLL |
| DDFVEIIKSQDLSVVSKVVKVTIDYTEISFMLWCKDGHVETFYPKLQSSQAWQPGVAMPNLYKMQRMLLEKCDLQNYGDSATLPKGIMMNV |
| AKYTQLCQYLNTLTLAVPYNMRVIHFGAGSDKGVAPGTAVLRQWLPTGTLLVDSDLNDFVSDADSTLIGDCATVHTANKWDLIISDMYDPKT |
| KNVTKENDSKEGFFTYICGFIQQKLALGGSVAIKITEHSWNADLYKLMGHFAWWTAFVTNVNASSSEAFLIGCNYLGKPREQIDGYVMHANYI |
| FWRNTNPIQLSSYSLFDMSKFPLKLRGTAVMSLKE |
| >Protein\S_2019-nCoV/Italy-INMI1 (Sprotein_hCoV19ItalyINMI1isI2020)(Genbank Acc. No: QIA98554) SEQ ID NO: 11 |
| MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFAS |
| TEKSNIIRGWIFGTTLDSKTQSLLIVNNATNVVIKVCEFQFCNDPFLGVYYHKNNKSWMESEFRVYSSANNCTFEYVSQPFLMDLEGKQGNFK |
| NLREFVFKNIDGYFKIYSKHTPINLVRDLPQGFSALEPLVDLPIGINITRFQTLLALHRSYLTPGDSSSGWTAGAAAYYVGYLQPRTFLLKYNENGT |
| ITDAVDCALDPLSETKCTLKSFTVEKGIYQTSNFRVQPTESIVRFPNITNLCPFGEVFNATRFASVYAWNRKRISNCVADYSVLYNSASFSTFKCYG |
| VSPTKLNDLCFTNVYADSFVIRGDEVRQIAPGQTGKIADYNYKLPDDFTGCVIAWNSNNLDSKVGGNYNYLYRLFRKSNLKPFERDISTEIYQAG |
| STPCNGVEGFNCYFPLQSYGFQPTNGVGYQPYRVVVLSFELLHAPATVCGPKKSTNLVKNKCVNFNFNGLTGTGVLTESNKKFLPFQQFGRDI |
| ADTTDAVRDPQTLEILDITPCSFGGVSVITPGTNTSNQVAVLYQDVNCTEVPVAIHADQLTPTWRVYSTGSNVFQTRAGCLIGAEHVNNSYEC |
| DIPIGAGICASYQTQTNSPRRARSVASQSIIAYTMSLGAENSVAYSNNSIAIPTNFTISVTTEILPVSMTKTSVDCTMYICGDSTECSNLLLQYGSF |
| CTQLNRALTGIAVEQDKNTQEVFAQVKQIYKTPPIKDFGGFNFSQILPDPSKPSKRSFIEDLLFNKVTLADAGFIKQYGDCLGDIAARDLICAQKF |
| NGLTVLPPLLTDEMIAQYTSALLAGTITSGWTFGAGAALQIPFAMQMAYRFNGIGVTQNVLYENQKLIANQFNSAIGKIQDSLSSTASALGKLQ |
| DVVNQNAQALNTLVKQLSSNFGAISSVLNDILSRLDKVEAEVQIDRLITGRLQSLQTYVTQQLIRAAEIRASANLAATKMSECVLGQSKRVDFC |
| GKGYHLMSFPQSAPHGVVFLHVTYVPAQEKNFTTAPAICHDGKAHFPREGVFVSNGTHWFVTQRNFYEPQIITTDNTFVSGNCDVVIGIVNN |
| TVYDPLQPELDSFKEELDKYFKNHTSPDVDLGDISGINASVVNIQKEIDRLNEVAKNLNESLIDLQELGKYEQYIKWPWYIWLGFIAGLIAIVMVT |
| IMLCCMTSCCSCLKGCCSCGSCCKFDEDDSEPVLKGVKLHYT |
| >hCoV-19/France/IDF0372-isI/2020\|EPI_ISL_410720\|2020-01-23 SEQ ID NO: 12 |
| ATTAAAGGTTTATACCTTCCCAGGTAACAAACCAACCAACTTTCGATCTCTTGTAGATCTGTTCTCTAAACGAACTTTAAAATCTGTGTGG |
| CTGTCACTCGGCTGCATGCTTAGTGCACTCACGCAGTATAATTAATAACTAATTACTGTCGTTGACAGGACACGAGTAACTCGTCTATCTT |
| CTGCAGGCTGCTTACGGTTTCGTCCGTGTTGCAGCCGATCATCAGCACATCTAGGTTTCGTCCGGGTGTGACCGAAAGGTAAGATGGAG |
| AGCCTTGTCCCTGGTTTCAACGAGAAAACACACGTCCAACTCAGTTTGCCTGTTTTACAGGTTCGCGACGTGCTCGTACGTGGCTTTGGA |
| GACTCCGTGGAGGAGGTCTTATCAGAGGCACGTCAACATCTTAAAGATGGCACTTGTGGCTTAGTAGAAGTTGAAAAAGGCGTTTTGCC |
| TCAACTTGAACAGCCCTATGTGTTCATCAAACGTTCGGATGCTCGAACTGCACCTCATGGTCATGTTATGGTTGAGCTGGTAGCAGAACT |
| CGAAGGCATTCAGTACGGTCGTAGTGGTGAGACACTTGGTGTCCTTGTCCCTCATGTGGGCGAAATACCAGTGGCTTACCGCAAGGTTC |
| TTCTTCGTAAGAACGGTAATAAAGGAGCTGGTGGCCATAGTTACGGCGCCGATCTAAAGTCATTTGACTTAGGCGACGAGCTTGGCACT |
| GATCCTTATGAAGATTTTCAAGAAAACTGGAACACTAAACATAGCAGTGGTGTTACCCGTGAACTCATGCGTGAGCTTAACGGAGGGGC |
| ATACACTCGCTATGTCGATAACAACTTCTGTGGCCCTGATGGCTACCCTCTTGAGTGCATTAAAGACCTTCTAGCACGTGCTGGTAAAGC |
| TTCATGCACTTTGTCCGAACAACTGGACTTTATTGACACTAAGAGGGGTGTATACTGCTGCCGTGAACATGAGCATGAAATTGCTTGGTA |
| CACGGAACGTTCTGAAAAGAGCTATGAATTGCAGACACCTTTTGAAATTAAATTGGCAAAGAAATTTGACACCTTCAATGGGGAATGTC |
| CAAATTTTGTATTTCCCTTAAATTCCATAATCAAGACTATTCAACCAAGGGTTGAAAAGAAAAAGCTTGATGGCTTTATGGGTAGAATTC |
| GATCTGTCTATCCAGTTGCGTCACCAAATGAATGCAACCAAATGTGCCTTTCAACTCTCATGAAGTGTGATCATTGTGGTGAAACTTCATG |
| GCAGACGGGCGATTTTGTTAAAGCCACTTGCGAATTTTGTGGCACTGAGAATTTGACTAAAGAAGGTGCCACTACTTGTGGTTACTTACC |
| CCAAAATGCTGTTGTTAAAATTTATTGTCCAGCATGTCACAATTCAGAAGTAGGACCTGAGCATAGTCTTGCCGAATACCATAATGAATC |
| TGGCTTGAAAACCATTCTTCGTAAGGGTGGTCGCACTATTGCCTTTGGAGGCTGTGTGTTCTCTTATGTTGGTTGCCATAACAAGTGTGC |
| CTATTGGGTTCCACGTGCTAGCGCTAACATAGGTTGTAACCATACAGGTGTTGTTGGAGAAGGTTCCGAAGGTCTTAATGACAACCTTCT |

| SEQUENCES |
|---|
| TGAAATACTCCAAAAGAGAAAGTCAACATCAATATTGTTGGTGACTTTAAACTTAATGAAGAGATCGCCATTATTTTGGCATCTTTTTCT |
| GCTTCCACAAGTGCTTTTGTGGAAACTGTGAAAGGTTTGGATTATAAAGCATTCAAACAAATTGTTGAATCCTGTGGTAATTTTAAAGTT |
| ACAAAAGGAAAAGCTAAAAAAGGTGCCTGGAATATTGGTGAACAGAAATCAATACTGAGTCCTCTTTATGCATTTGCATCAGAGGCTGC |
| TCGTGTTGTACGATCAATTTTCTCCCGCACTCTTGAAACTGCTCAAAATTCTGTGCGTGTTTTACAGAAGGCCGCTATAACAATACTAGAT |
| GGAATTTCACAGTATTCACTGAGACTCATTGATGCTATGATGTTCACATCTGATTTGGCTACTAACAATCTAGTTGTAATGGCCTACATTA |
| CAGGTGGTGTTGTTCAGTTGACTTCGCAGTGGCTAACTAACATCTTTGGCACTGTTTATGAAAAACTCAAACCCGTCCTTGATTGGCTTGA |
| AGAGAAGTTTAAGGAAGGTGTAGAGTTTCTTAGAGACGGTTGGGAAATTGTTAAATTTATCTCAACCTGTGCTTGTGAAATTGTCGGTG |
| GACAAATTGTCACCTGTGCAAAGGAAATTAAGGAGAGTGTTCAGACATTCTTTAAGCTTGTAAATAAATTTTTGGCTTTGTGTGCTGACT |
| CTATCATTATTGGTGGAGCTAAACTTAAAGCCTTGAATTTAGGTGAAACATTTGTCACGCACTCAAAGGGATTGTACAGAAAGTGTGTTA |
| AATCCAGAGAAGAAACTGGCCTACTCATGCCTCTAAAAGCCCCAAAAGAAATTATCTTCTTAGAGGGAGAAACACTTCCCACAGAAGTG |
| TTAACAGAGGAAGTTGTCTTGAAAACTGGTGATTTACAACCATTAGAACAACCTACTAGTGAAGCTGTTGAAGCTCCATTGGTTGGTACA |
| CCAGTTTGTATTAACGGGCTTATGTTGCTCGAAATCAAAGACACAGAAAAGTACTGTGCCCTTGCACCTAATATGATGGTAACAAACAAT |
| ACCTTCACACTCAAAGGCGGTGCACCAACAAAGGTTACTTTTGGTGATGACACTGTGATAGAAGTGCAAGGTTACAAGAGTGTGAATAT |
| CACTTTTGAACTTGATGAAAGGATTGATAAAGTACTTAATGAGAAGTGCTCTGCCTATACAGTTGAACTCGGTACAGAAGTAAATGAGTT |
| CGCCTGTGTTGTGGCAGATGCTGTCATAAAAACTTTGCAACCAGTATCTGAATTACTTACACCACTGGGCATTGATTTAGATGAGTGGAG |
| TATGGCTACATACTACTTATTTGATGAGTCTGGTGAGTTTAAATTGGCTTCACATATGTATTGTTCTTTCTACCCTCCAGATGAGGATGAA |
| GAAGAAGGTGATTGTGAAGAAGAAGAGTTTGAGCCATCAACTCAATATGAGTATGGTACTGAAGATGATTACCAAGGTAAACCTTTGG |
| AATTTGGTGCCACTTCTGCTGCTCTTCAACCTGAAGAAGAGCAAGAAGAAGATTGGTTAGATGATGATAGTCAACAAACTGTTGGTCAA |
| CAAGACGGCAGTGAGGACAATCAGACAACTACTATTCAAACAATTGTTGAGGTTCAACCTCAATTAGAGATGGAACTTACACCAGTTGT |
| TCAGACTATTGAAGTGAATAGTTTTAGTGGTTATTTAAAACTTACTGACAATGTATACATTAAAAATGCAGACATTGTGGAAGAAGCTAA |
| AAAGGTAAAACCAACAGTGGTTGTTAATGCAGCCAATGTTTACCTTAAACATGGAGGAGGTGTTGCAGGAGCCTTAAATAAGGCTACTA |
| ACAATGCCATGCAAGTTGAATCTGATGATTACATAGCTACTAATGGACCACTTAAAGTGGGTGGTAGTTGTGTTTTAAGCGGACACAATC |
| TTGCTAAACACTGTCTTCATGTTGTCGGCCCAAATGTTAACAAAGGTGAAGACATTCAACTTCTTAAGAGTGCTTATGAAAATTTTAATCA |
| GCACGAAGTTCTACTTGCACCATTATTATCAGCTGGTATTTTGGTGCTGACCCTATACATTCTTTAAGAGTTTGTGTAGATACTGTTCGCA |
| CAAATGTCTACTTAGCTGTCTTTGATAAAAATCTCTATGACAAACTTGTTTCAAGCTTTTTGGAAATGAAGAGTGAAAAGCAAGTTGAAC |
| AAAAGATCGCTGAGATTCCTAAAGAGGAAGTTAAGCCATTTATAACTGAAAGTAAACCTTCAGTTGAACAGAGAAAACAAGATGATAAG |
| AAAATCAAAGCTTGTGTTGAAGAAGTTACAACAACTCTGGAAGAAACTAAGTTCCTCACAGAAAACTTGTTACTTTATATTGACATTAAT |
| GGCAATCTTCATCCAGATTCTGCCACTCTTGTTAGTGACATTGACATCACTTTCTTAAAGAAAGATGCTCCATATATAGTGGGTGATGTTG |
| TTCAAGAGGGTGTTTTAACTGCTGTGGTTATACCTACTAAAAAGGCTGGTGGCACTACTGAAATGCTAGCGAAAGCTTTGAGAAAAGTG |
| CCAACAGACAATTATATAACCACTTACCCGGGTCAGGGTTTAAATGGTTACACTGTAGAGGAGGCAAAGACAGTGCTTAAAAAGTGTAA |
| AAGTGCCTTTTACATTCTACCATCTATTATCTCTAATGAGAAGCAAGAAATTCTTGGAACTGTTTCTTGGAATTTGCGAGAAATGCTTGCA |
| CATGCAGAAGAAACACGCAAATTAATGCCTGTCTGTGTGGAAACTAAAGCCATAGTTTCAACTATACAGCGTAAATATAAGGGTATTAA |
| AATACAAGAGGGTGTGGTTGATTATGGTGCTAGATTTTACTTTTACACCAGTAAAACAACTGTAGCGTCACTTATCAACACACTTAACGA |
| TCTAAATGAAACTCTTGTTACAATGCCACTTGGCTATGTAACACATGGCTTAAATTTGGAAGAAGCTGCTCGGTATATGAGATCTCTCAA |
| AGTGCCAGCTACAGTTTCTGTTTCTTCACCTGATGCTGTTACAGCGTATAATGGTTATCTTACTTCTTCTTCTAAAACACCTGAAGAACATT |
| TTATTGAAACCATCTCACTTGCTGGTTCCTATAAAGATTGGTCCTATTCTGGACAATCTACACAACTAGGTATAGAATTTCTTAAGAGAGG |
| TGATAAAAGTGTATATTACACTAGTAATCCTACCACATTCCACCTAGATGGTGAAGTTATCACCTTTGACAATCTTAAGACACTTCTTTCTT |
| TGAGAGAAGTGAGGACTATTAAGGTGTTTACAACAGTAGACAACATTAACCTCCACACGCAAGTTGTGGACATGTCAATGACATATGGA |

| SEQUENCES |
|---|
| CAACAGTTTGGTCCAACTTATTTGGATGGAGCTGATGTTACTAAAATAAAACCTCATAATTCACATGAAGGTAAAACATTTTATGTTTTAC |
| CTAATGATGACACTCTACGTGTTGAGGCTTTTGAGTACTACCACACAACTGATCCTAGTTTTCTGGGTAGGTACATGTCAGCATTAAATCA |
| CACTAAAAAGTGGAAATACCCACAAGTTAATGGTTTAACTTCTATTAAATGGGCAGATAACAACTGTTATCTTGCCACTGCATTGTTAACA |
| CTCCAACAAATAGAGTTGAAGTTTAATCCACCTGCTCTACAAGATGCTTATTACAGAGCAAGGGCTGGTGAAGCTGCTAACTTTTGTGCA |
| CTTATCTTAGCCTACTGTAATAAGACAGTAGGTGAGTTAGGTGATGTTAGAGAAACAATGAGTTACTTGTTTCAACATGCCAATTTAGAT |
| TCTTGCAAAAGAGTCTTGAACGTGGTGTGTAAAACTTGTGGACAACAGCAGACAACCCTTAAGGGTGTAGAAGCTGTTATGTACATGGG |
| CACACTTTCTTATGAACAATTTAAGAAAGGTGTTCAGATACCTTGTACGTGTGGTAAACAAGCTACAAAATATCTAGTACAACAGGAGTC |
| ACCTTTTGTTATGATGTCAGCACCACCTGCTCAGTATGAACTTAAGCATGGTACATTTACTTGTGCTAGTGAGTACACTGGTAATTACCAG |
| TGTGGTCACTATAAACATATAACTTCTAAAGAAACTTTGTATTGCATAGACGGTGCTTTACTTACAAAGTCCTCAGAATACAAAGGTCCTA |
| TTACGGATGTTTTCTACAAAGAAAACAGTTACACAACAACCATAAAACCAGTTACTTATAAATTGGATGGTGTTGTTTGTACAGAAATTG |
| ACCCTAAGTTGGACAATTATTATAAGAAAGACAATTCTTATTTCACAGAGCAACCAATTGATCTTGTACCAAACCAACCATATCCAAACGC |
| AAGCTTCGATAATTTTAAGTTTGTATGTGATAATATCAAATTTGCTGATGATTTAAACCAGTTAACTGGTTATAAGAAACCTGCTTCAAGA |
| GAGCTTAAAGTTACATTTTTCCCTGACTTAAATGGTGATGTGGTGGCTATTGATTATAAACACTACACACCCTCTTTTAAGAAAGGAGCTA |
| AATTGTTACATAAACCTATTGTTTGGCATGTTAACAATGCAACTAATAAAGCCACGTATAAACCAAATACCTGGTGTATACGTTGTCTTTG |
| GAGCACAAAACCAGTTGAAACATCAAATTCGTTTGATGTACTGAAGTCAGAGGACGCGCAGGGAATGGATAATCTTGCCTGCGAAGAT |
| CTAAAACCAGTCTCTGAAGAAGTAGTGGAAATCCTACCATACAGAAAGACGTTCTTGAGTGTAATGTGAAAACTACCGAAGTTGTAGG |
| AGACATTATACTTAAACCAGCAAATAATAGTTTAAAAATTACAGAAGAGGTTGGCCACACAGATCTAATGGCTGCTTATGTAGACAATTC |
| TAGTCTTACTATTAAGAAACCTAATGAATTATCTAGAGTATTAGGTTTGAAAACCCTTGCTACTCATGGTTTAGCTGCTGTTAATAGTGTC |
| CCTTGGGATACTATAGCTAATTATGCTAAGCCTTTTCTTAACAAAGTTGTTAGTACAACTACTAACATAGTTACACGGTGTTTAAACCGTG |
| TTTGTACTAATTATATGCCTTATTTCTTTACTTTATTGCTACAATTGTGTACTTTTACTAGAAGTACAAATTCTAGAATTAAAGCATCTATGC |
| CGACTACTATAGCAAAGAATACTGTTAAGAGTGTCGGTAAATTTTGTCTAGAGGCTTCATTTAATTATTTGAAGTCACCTAATTTTTCTAA |
| ACTGATAAATATTATAATTTGGTTTTTACTATTAAGTGTTTGCCTAGGTTCTTTAATCTACTCAACCGCTGCTTTAGGTGTTTTAATGTCTAA |
| TTTAGGCATGCCTTCTTACTGTACTGGTTACAGAGAAGGCTATTTGAACTCTACTAATGTCACTATTGCAACCTACTGTACTGGTTCTATAC |
| CTTGTAGTGTTTGTCTTAGTGGTTTAGATTCTTTAGACACCTATCCTTCTTTAGAAACTATACAAATTACCATTTCATCTTTTAAATGGGATT |
| TAACTGCTTTTGGCTTAGTTGCAGAGTGGTTTTTGGCATATATTCTTTTCACTAGGTTTTTCTATGTACTTGGATTGGCTGCAATCATGCAA |
| TTGTTTTTCAGCTATTTTGCAGTACATTTTATTAGTAATTCTTGGCTTATGTGGTTAATAATTAATCTTGTACAAATGGCCCCGATTTCAGCT |
| ATGGTTAGAATGTACATCTTCTTTGCATCATTTTATTATGTATGGAAAAGTTATGTGCATGTTGTAGACGGTTGTAATTCATCAACTTGTAT |
| GATGTGTTACAAACGTAATAGAGCAACAAGAGTCGAATGTACAACTATTGTTAATGGTGTTAGAAGGTCCTTTTATGTCTATGCTAATGG |
| AGGTAAAGGCTTTTGCAAACTACACAATTGGAATTGTGTTAATTGTGATACATTCTGTGCTGGTAGTACATTTATTAGTGATGAAGTTGC |
| GAGAGACTTGTCACTACAGTTTAAAAGACCAATAAATCCTACTGACCAGTCTTCTTACATCGTTGATAGTGTTACAGTGAAGAATG |
| GTTCCATCCATCTTTACTTTGATAAAGCTGGTCAAAAGACTTATGAAAGACATTCTCTCTCATTTTGTTAACTTAGACAACCTGAGAGCT |
| AATAACACTAAAGGTTCATTGCCTATTAATGTTATAGTTTTTGATGGTAAATCAAAATGTGAAGAATCATCTGCAAAATCAGCGTCTGTTT |
| ACTACAGTCAGCTTATGTGTCAACCTATACTGTTACTAGATCAGGCATTAGTGTCTGATGTTGGTGATAGTGCGGAAGTTGCAGTTAAA |
| TGTTTGATGCTTACGTTAATACGTTTTCATCAACTTTTAACGTACCAATGGAAAAACTCAAAACACTAGTTGCAACTGCAGAAGCTGAACT |
| TGCAAAGAATGTGTCCTTAGACAATGTCTTATCTACTTTTATTTCAGCAGCTCGGCAAGGGTTTGTTGATTCAGATGTAGAAACTAAAGA |
| TGTTGTTGAATGTCTTAAATTGTCACATCAATCTGACATAGAAGTTACTGGCGATAGTTGTAATAACTATATGCTCACCTATAACAAAGTT |
| GAAAACATGACACCCCGTGACCTTGGTGCTTGTATTGACTGTAGTGCGCGTCATATTAATGCGCAGGTAGCAAAAGTCACAACATTGC |
| TTTGATATGGAACGTTAAAGATTTCATGTCATTGTCTGAACAACTACGAAAACAAATACGTAGTGCTGCTAAAAGAATAACTTACCTTTT |
| AAGTTGACATGTGCAACTACTAGACAAGTTGTTAATGTTGTAACAACAAAGATAGCACTTAAGGGTGGTAAAATTGTTAATAATTGGTTG |

| SEQUENCES |
|---|
| AAGCAGTTAATTAAAGTTACACTTGTGTTCCTTTTTGTTGCTGCTATTTTCTATTTAATAACACCTGTTCATGTCATGTCTAAACATACTGAC |
| TTTTCAAGTGAAATCATAGGATACAAGGCTATTGATGGTGGTGTCACTCGTGACATAGCATCTACAGATACTTGTTTTGCTAACAAACAT |
| GCTGATTTTGACACATGGTTTAGCCAGCGTGGTGGTAGTTATACTAATGACAAAGCTTGCCCATTGATTGCTGCAGTCATAACAAGAGAA |
| GTGGGTTTTGTCGTGCCTGGTTTGCCTGGCACGATATTACGCACAACTAATGGTGACTTTTTGCATTTCTTACCTAGAGTTTTTAGTGCAG |
| TTGGTAACATCTGTTACACACCATCAAAACTTATAGAGTACACTGACTTTGCAACATCAGCTTGTGTTTGGCTGCTGAATGTACAATTTT |
| TAAAGATGCTTCTGGTAAGCCAGTACCATATTGTTATGATACCAATGTACTAGAAGGTTCTGTTGCTTATGAAAGTTTACGCCCTGACAC |
| ACGTTATGTGCTCATGGATGGCTCTATTATTCAATTTCCTAACACCTACCTTGAAGGTTCTGTTAGAGTGGTAACAACTTTTGATTCTGAG |
| TACTGTAGGCACGGCACTTGTGAAAGATCAGAAGCTGGTGTTTGTGTATCTACTAGTGGTAGATGGGTACTTAACAATGATTATTACAG |
| ATCTTTACCAGGAGTTTTCTGTGGTGTAGATGCTGTAAATTTACTTACTAATATGTTTACACCACTAATTCAACCTATTGGTGCTTTGGACA |
| TATCAGCATCTATAGTAGCTGGTGGTATTGTAGCTATCGTAGTAACATGCCTTGCCTACTATTTTATGAGGTTTAGAAGAGCTTTTGGTGA |
| ATACAGTCATGTAGTTGCCTTTAATACTTTACTATTCCTTATGTCATTCACTGTACTCTGTTTAACACCAGTTTACTCATTCTTACCTGGTGT |
| TTATTCTGTTATTTACTTGTACTTGACATTTTATCTTACTAATGATGTTTCTTTTTTAGCACATATTCAGTGGATGGTTATGTTCACACCTTTA |
| GTACCTTTCTGGATAACAATTGCTTATATCATTTGTATTTCCACAAAGCATTTCTATTGGTTCTTTAGTAATTACCTAAAGAGACGTGTA |
| GTCTTTAATGGTGTTTCCTTTAGTACTTTTGAAGAAGCTGCGCTGTGCACCTTTTTGTTAAATAAAGAAATGTATCTAAAGTTGCGTAGTG |
| ATGTGCTATTACCTCTTACGCAATATAATAGATACTTAGCTCTTTATAATAAGTACAAGTATTTTAGTGGAGCAATGGATACAACTAGCTA |
| CAGAGAAGCTGCTTGTTGTCATCTCGCAAAGGCTCTCAATGACTTCAGTAACTCAGGTTCTGATGTTCTTTACCAACCACCACAAACCTCT |
| ATCACCTCAGCTGTTTTGCAGAGTGGTTTTAGAAAAATGGCATTCCCATCTGGTAAAGTTGAGGGTTGTATGGTACAAGTAACTTGTGGT |
| ACAACTACACTTAACGGTCTTTGGCTTGATGACGTAGTTTACTGTCCAAGACATGTGATCTGCACCTCTGAAGACATGCTTAACCCTAATT |
| ATGAAGATTTACTCATTCGTAAGTCTAATCATAATTTCTTGGTACAGGCTGGTAATGTTCAACTCAGGGTTATTGGACATTCTATGCAAAA |
| TTGTGTACTTAAGCTTAAGGTTGATACAGCCAATCCTAAGACACCTAAGTATAAGTTTGTTCGCATTCAACCAGGACAGACTTTTTCAGTG |
| TTAGCTTGTTACAATGGTTCACCATCTGGTGTTTACCAATGTGCTATGAGGCCCAATTTCACTATTAAGGGTTCATTCCTTAATGGTTCATG |
| TGGTAGTGTTGGTTTTAACATAGATTATGACTGTGTCTCTTTTTGTTACATGCACCATATGGAATTACCAACTGGAGTTCATGCTGGCACA |
| GACTTAGAAGGTAACTTTTATGGACCTTTTGTTGACAGGCAAACAGCACAAGCAGCTGGTACGGACACAACTATTACAGTTAATGTTTTA |
| GCTTGGTTGTACGCTGCTGTTATAAATGGAGACAGGTGGTTTCTCAATCGATTTACCACAACTCTTAATGACTTTAACCTTGTGGCTATGA |
| AGTACAATTATGAACCTCTAACACAAGACCATGTTGACATACTAGGACCTCTTTCTGCTCAAACTGGAATTGCCGTTTTAGATATGTGTGC |
| TTCATTAAAAGAATTACTGCAAAATGGTATGAATGGACGTACCATATTGGGTAGTGCTTTATTAGAAGATGAATTTACACCTTTTGATGTT |
| GTTAGACAATGCTCAGGTGTTACTTTCCAAAGTGCAGTGAAAAGAACAATCAAGGGTACACACCACTGGTTGTTACTCACAATTTTGACT |
| TCACTTTTAGTTTTAGTCCAGAGTACTCAATGGTCTTTGTTCTTTTTTTGTATGAAAATGCCTTTTTACCTTTTGCTATGGGTATTATTGCT |
| ATGTCTGCTTTTGCAATGATGTTTGTCAAACATAAGCATGCATTTCTCTGTTTGTTTTTGTTACCTTCTCTTGCCACTGTAGCTTATTTTAAT |
| ATGGTCTATATGCCTGCTAGTTGGGTGATGCGTATTATGACATGGTTGGATATGGTTGATACTAGTTTGTCTGGTTTTAAGCTAAAAGAC |
| TGTGTTATGTATGCATCAGCTGTAGTGTTACTAATCCTTATGACAGCAAGAACTGTGTATGATGATGGTGCTAGGAGAGTGTGGACACTT |
| ATGAATGTCTTGACACTCGTTTATAAAGTTTATTATGGTAATGCTTTAGATCAAGCCATTTCCATGTGGGCTCTTATAATCTCTGTTACTTC |
| TAACTACTCAGGTGTAGTTACAACTGTCATGTTTTTGGCCAGAGGTATTGTTTTATGTGTGTTGAGTATTGCCCTATTTTCTTCATAACTG |
| GTAATACACTTCAGTGTATAATGCTAGTTTATTGTTTCTTAGGCTATTTTTGTACTTGTTACTTTGGCCTCTTTTGTTTACTCAACCGCTACT |
| TTAGACTGACTCTTGGTGTTTATGATTACTTAGTTTCTACACAGGAGTTTAGATATATGAATTCACAGGGACTACTCCCACCCAAGAATAG |
| CATAGATGCCTTCAAACTCAACATTAAATTGTTGGGTGTTGGTGGCAAACCTTGTATCAAAGTAGCCACTGTACAGTCTAAAATGTCAGA |
| TGTAAAGTGCACATCAGTAGTCTTACTCTCAGTTTTGCAACAACTCAGAGTAGAATCATCATCTAAATTGTGGGCTCAATGTGTCCAGTTA |
| CACAATGACATTCTCTTAGCTAAAGATACTACTGAAGCCTTTGAAAAATGGTTTCACTACTTTCTGTTTTGCTTTCCATGCAGGGTGCTG |

| SEQUENCES |
|---|
| TAGACATAAACAAGCTTTGTGAAGAAATGCTGGACAACAGGGCAACCTTACAAGCTATAGCCTCAGAGTTTAGTTCCCTTCCATCATATG |
| CAGCTTTTGCTACTGCTCAAGAAGCTTATGAGCAGGCTGTTGCTAATGGTGATTCTGAAGTTGTTCTTAAAAAGTTGAAGAAGTCTTTGA |
| ATGTGGCTAAATCTGAATTTGACCGTGATGCAGCCATGCAACGTAAGTTGGAAAAGATGGCTGATCAAGCTATGACCCAAATGTATAAA |
| CAGGCTAGATCTGAGGACAAGAGGGCAAAAGTTACTAGTGCTATGCAGACAATGCTTTTCACTATGCTTAGAAAGTTGGATAATGATGC |
| ACTCAACAACATTATCAACAATGCAAGAGATGGTTGTGTTCCCTTGAACATAATACCTCTTACAACAGCAGCCAAACTAATGGTTGTCAT |
| ACCAGACTATAACACATATAAAAATACGTGTGATGGTACAACATTTACTTATGCATCAGCATTGTGGGAAATCCAACAGGTTGTAGATGC |
| AGATAGTAAAATTGTTCAACTTAGTGAAATTAGTATGGACAATTCACCTAATTTAGCATGGCCTCTTATTGTAACAGCTTTAAGGGCCAAT |
| TCTGCTGTCAAATTACAGAATAATGAGCTTAGTCCTGTTGCACTACGACAGATGTCTTGTGCTGCCGGTACTACACAAACTGCTTGCACT |
| GATGACAATGCGTTAGCTTACTACAACACAACAAAGGGAGGTAGGTTTGTACTTGCACTGTTATCCGATTTACAGGATTTGAAATGGGC |
| TAGATTCCCTAAGAGTGATGGAACTGGTACTATCTATACAGAACTGGAACCACCTTGTAGGTTTGTTACAGACACACCTAAAGGTCCTAA |
| AGTGAAGTATTTATACTTTATTAAAGGATTAAACAACCTAAATAGAGGTATGGTACTTGGTAGTTTAGCTGCCACAGTACGTCTACAAGC |
| TGGTAATGCAACAGAAGTGCCTGCCAATTCAACTGTATTATCTTTCTGTGCTTTTGCTGTAGATGCTGCTAAAGCTTACAAAGATTATCTA |
| GCTAGTGGGGGACAACCAATCACTAATTGTGTTAAGATGTTGTGTACACACACTGGTACTGGTCAGGCAATAACAGTTACACCGGAAGC |
| CAATATGGATCAAGAATCCTTTGGTGGTGCATCGTGTTGTCTGTACTGCCGTTGCCACATAGATCATCCAAATCCTAAAGGATTTTGTGA |
| CTTAAAAGGTAAGTATGTACAAATACCTACAACTTGTGCTAATGACCCTGTGGGTTTTACACTTAAAAACACAGTCTGTACCGTCTGCGG |
| TATGTGGAAAGGTTATGGCTGTAGTTGTGATCAACTCCGCGAACCCATGCTTCAGTCAGCTGATGCACAATCGTTTTTAAACGGGTTTGC |
| GGTGTAAGTGCAGCCCGTCTTACACCGTGCGGCACAGGCACTAGTACTGATGTCGTATACAGGGCTTTTGACATCTACAATGATAAAGT |
| AGCTGGTTTTGCTAAATTCCTAAAAACTAATTGTTGTCGCTTCCAAGAAAAGGACGAAGATGACAATTTAATTGATTCTTACTTTGTAGTT |
| AAGAGACACACTTTCTCTAACTACCAACATGAAGAAACAATTTATAATTTACTTAAGGATTGTCCAGCTGTTGCTAAACATGACTTCTTTA |
| AGTTTAGAATAGACGGTGACATGGTACCACATATATCACGTCAACGTCTTACTAAATACACAATGGCAGACCTCGTCTATGCTTAAGGC |
| ATTTTGATGAAGGTAATTGTGACACATTAAAAGAAATACTTGTCACATACAATTGTTGTGATGATGATTATTTCAATAAAAAGGACTGGT |
| ATGATTTTGTAGAAAACCCAGATATATTACGCGTATACGCCAACTTAGGTGAACGTGTACGCCAAGCTTTGTTAAAAACAGTACAATTCT |
| GTGATGCCATGCGAAATGCTGGTATTGTTGGTGTACTGACATTAGATAATCAAGATCTCAATGGTAACTGGTATGATTTCGGTGATTTCA |
| TACAAACCACGCCAGGTAGTGGAGTTCCTGTTGTAGATTCTTATTATTCATTGTTAATGCCTATATTAACCTTGACCAGGGCTTTAACTGC |
| AGAGTCACATGTTGACACTGACTTAACAAAGCCTTACATTAAGTGGGATTTGTTAAAATATGACTTCACGGAAGAGAGGTTAAAACTCTT |
| TGACCGTTATTTTAAATATTGGGATCAGACATACCACCCAAATTGTGTTAACTGTTTGGATGACAGATGCATTCTGCATTGTGCAAACTTT |
| AATGTTTTATTCTCTACAGTGTTCCCACCTACAAGTTTTGGACCACTAGTGAGAAAAATATTTGTTGATGGTGTTCCATTTGTAGTTTCAAC |
| TGGATACCACTTCAGAGAGCTAGGTGTTGTACATAATCAGGATGTAAACTTACATAGCTCTAGACTTAGTTTTAAGGAATTACTTGTGTA |
| TGCTGCTGACCCTGCTATGCACGCTGCTTCTGGTAATCTATTACTAGATAAACGCACTACGTGCTTTTCAGTAGCTGCACTTACTAACAAT |
| GTTGCTTTTCAAACTGTCAAACCCGGTAATTTTAACAAAGACTTCTATGACTTTGCTGTGTCTAAGGGGTTTCTTTAAGGAAGGAAGTTCTG |
| TTGAATTAAAACACTTCTTCTTTGCTCAGGATGGTAATGCTGCTATCAGCGATTATGACTACTATCGTTATAATCTACCAACAATGTGTGA |
| TATCAGACAACTACTATTTGTAGTTGAAGTTGTTGATAAGTACTTTGATTGTTACGATGGTGGCTGTATTAATGCTAACCAAGTCATCGTC |
| AACAACCTAGACAAATCAGCTGGTTTTCCATTTAATAAATGGGGTAAGGCTAGACTTTATTATGATTCAATGAGTTATGAGGATCAAGAT |
| GCACTTTTCGCATATACAAAACGTAATGTCATCCCTACTATAACTCAAATGAATCTTAAGTATGCCATTAGTGCAAAGAATAGAGCTCGCA |
| CCGTAGCTGGTGTCTCTATCTGTAGTACTATGACCAATAGACAGTTTCATCAAAAATTATTGAAATCAATAGCCGCCACTAGAGGAGCTA |
| CTGTAGTAATTGGAACAAGCAAATTCTATGGTGGTTGGCACAACATGTTAAAAACTGTTTATAGTGATGTAGAAAACCCTCACCTTATGG |
| GTTGGGATTATCCTAAATGTGATAGAGCCATGCCTAACATGCTTAGAATTATGGCCTCACTTGTTCTTGCTCGCAAACATACAACGTGTTG |
| TAGCTTGTCACACCGTTTCTATAGATTAGCTAATGAGTGTGCTCAAGTATTGAGTGAAATGGTCATGTGTGGCGGTTCACTATATGTTAA |
| ACCAGGTGGAACCTCATCAGGAGATGCCACAACTGCTTATGCTAATAGTGTTTTTAACATTTGTCAAGCTGTCACGGCCAATGTTAATGC |

| SEQUENCES |
| --- |
| ACTTTTATCTACTGATGGTAACAAAATTGCCGATAAGTATGTCCGCAATTTACAACACAGACTTTATGAGTGTCTCTATAGAAATAGAGAT |
| GTTGACACAGACTTTGTGAATGAGTTTTACGCATATTTGCGTAAACATTTCTCAATGATGATACTCTCTGACGATGCTGTTGTGTGTTTCA |
| ATAGCACTTATGCATCTCAAGGTCTAGTGGCTAGCATAAAGAACTTTAAGTCAGTTCTTTATTATCAAAACAATGTTTTTATGTCTGAAGC |
| AAAATGTTGGACTGAGACTGACCTTACTAAAGGACCTCATGAATTTTGCTCTCAACATACAATGCTAGTTAAACAGGGTGATGATTATGT |
| GTACCTTCCTTACCCAGATCCATCAAGAATCCTAGGGGCCGGCTGTTTTGTAGATGATATCGTAAAAACAGATGGTACACTTATGATTGA |
| ACGGTTCGTGTCTTTAGCTATAGATGCTTACCCACTTACTAAACATCCTAATCAGGAGTATGCTGATGTCTTTCATTTGTACTTACAATACA |
| TAAGAAAGCTACATGATGAGTTAACAGGACACATGTTAGACATGTATTCTGTTATGCTTACTAATGATAACACTTCAAGGTATTGGGAAC |
| CTGAGTTTTATGAGGCTATGTACACACCGCATACAGTCTTACAGGCTGTTGGGGCTTGTGTTCTTTGCAATTCACAGACTTCATTAAGATG |
| TGGTGCTTGCATACGTAGACCATTCTTATGTTGTAAATGCTGTTACGACCATGTCATATCAACATCACATAAATTAGTCTTGTCTGTTAATC |
| CGTATGTTTGCAATGCTCCAGGTTGTGATGTCACAGATGTGACTCAACTTTACTTAGGAGGTATGAGCTATTATTGTAAATCACATAAAC |
| CACCCATTAGTTTTCCATTGTGTGCTAATGGACAAGTTTTTGGTTTATATAAAAATACATGTGTTGGTAGCGATAATGTTACTGACTTTAA |
| TGCAATTGCAACATGTGACTGGACAAATGCTGGTGATTACATTTTAGCTAACACCTGTACTGAAAGACTCAAGCTTTTTGCAGCAGAAAC |
| GCTCAAAGCTACTGAGGAGACATTTAAACTGTCTTATGGTATTGCTACTGTACGTGAAGTGCTGTCTGACAGAGAATTACATCTTTCATG |
| GGAAGTTGGTAAACCTAGACCACCACTTAACCGAAATTATGTCTTTACTGGTTATCGTGTAACTAAAAACAGTAAAGTACAAATAGGAG |
| AGTACACCTTTGAAAAAGGTGACTATGGTGATGCTGTTGTTTACCGAGGTACAACAACTTACAAATTAAATGTTGGTGATTATTTTGTGC |
| TGACATCACATACAGTAATGCCATTAAGTGCACCTACACTAGTGCCACAAGAGCACTATGTTAGAATTACTGGCTTATACCCAACACTCA |
| ATATCTCAGATGAGTTTTCTAGCAATGTTGCAAATTATCAAAAGGTTGGTATGCAAAAGTATTCTACACTCCAGGGACCACCTGGTACTG |
| GTAAGAGTCATTTTGCTATTGGCCTAGCTCTCTACTACCCTTCTGCTCGCATAGTGTATACAGCTTGCTCTCATGCCGCTGTTGATGCACTA |
| TGTGAGAAGGCATTAAAATATTTGCCTATAGATAAATGTAGTAGAATTATACCTGCACGTGCTCGTGTAGAGTGTTTTGATAAATTCAAA |
| GTGAATTCAACATTAGAACAGTATGTCTTTTGTACTGTAAATGCATTGCCTGAGACGACAGCAGATATAGTTGTCTTTGATGAAATTTCA |
| ATGGCCACAAATTATGATTTGAGTGTTGTCAATGCCAGATTACGTGCTAAGCACTATGTGTACATTGGCGACCCTGCTCAATTACCTGCA |
| CCACGCACATTGCTAACTAAGGGCACACTAGAACCAGAATATTTCAATTCAGTGTGTAGACTTATGAAAACTATAGGTCCAGACATGTTC |
| CTCGGAACTTGTCGGCGTTGTCCTGCTGAAATTGTTGACACTGTGAGTGCTTTGGTTTATGATAATAAGCTTAAAGCACATAAAGACAAA |
| TCAGCTCAATGCTTTAAAATGTTTTATAAGGGTGTTATCACGCATGATGTTTCATCTGCAATTAACAGGCCACAAATAGGCGTGGTAAGA |
| GAATTCCTTACACGTAACCCTGCTTGGAGAAAAGCTGTCTTTATTTCACCTTATAATTCACAGAATGCTGTAGCCTCAAAGATTTTGGGAC |
| TACCAACTCAAACTGTTGATTCATCACAGGGCTCAGAATATGACTATGTCATATTCACTCAAACCACTGAAACAGCTCACTCTTGTAATGT |
| AAACAGATTTAATGTTGCTATTACCAGAGCAAAAGTAGGCATACTTTGCATAATGTCTGATAGAGACCTTTATGACAAGTTGCAATTTAC |
| AAGTCTTGAAATTCCACGTAGGAATGTGGCAACTTTACAAGCTGAAAATGTAACAGGACTCTTTAAAGATTGTAGTAAGGTAATCACTG |
| GGTTACATCCTACACAGGCACCTACACACCTCAGTGTTGACACTAAATTCAAAACTGAAGGTTTATGTGTTGACATACCTGGCATACCTA |
| AGGACATGACCTATAGAAGACTCATCTCTATGATGGGTTTTAAAATGAATTATCAAGTTAATGGTTACCCTAACATGTTTATCACCCGCG |
| AAGAAGCTATAAGACATGTACGTGCATGGATTGGCTTCGATGTCGAGGGGTGTCATGCTACTAGAGAAGCTGTTGGTACCAATTTACCT |
| TTACAGCTAGGTTTTTCTACAGGTGTTAACCTAGTTGCTGTACCTACAGGTTATGTTGATACACCTAATAATACAGATTTTTCCAGAGTTA |
| GTGCTAAACCACCGCCTGGAGATCAATTTAAACACCTCATACCACTTATGTACAAAGGACTTCCTTGGAATGTAGTGCGTATAAAGATTG |
| TACAAATGTTAAGTGACACACTTAAAAATCTCTCTGACAGAGTCGTATTTGTCTTATGGGCACATGGCTTTGAGTTGACATCTATGAAGT |
| ATTTTGTGAAAATAGGACCTGAGCGCACCTGTTGTCTATGTGATAGACGTGCCACATGCTTTTCCACTGCTTCAGACACTTATGCCTGTTG |
| GCATCATTCTATTGGATTTGATTACGTCTATAATCCGTTTATGATTGATGTTCAACAATGGGGTTTTACAGGTAACCTACAAAGCAACCAT |
| GATCTGTATTGTCAAGTCCATGGTAATGCACATGTAGCTAGTTGTGATGCAATCATGACTAGGTGTCTAGCTGTCCACGAGTGCTTTGTT |
| AAGCGTGTTGACTGGACTATTGAATATCCTATAATTGGTGATGAACTGAAGATTAATGCGGCTTGTAGAAAGGTTCAACACATGGTTGTT |

| SEQUENCES |
| --- |
| AAAGCTGCATTATTAGCAGACAAATTCCCAGTTCTTCACGACATTGGTAACCCTAAAGCTATTAAGTGTGTACCTCAAGCTGATGTAGAA |
| TGGAAGTTCTATGATGCACAGCCTTGTAGTGACAAAGCTTATAAAATAGAAGAATTATTCTATTCTTATGCCACACATTCTGACAAATTCA |
| CAGATGGTGTATGCCTATTTTGGAATTGCAATGTCGATAGATATCCTGCTAATTCCATTGTTTGTAGATTTGACACTAGAGTGCTATCTAA |
| CCTTAACTTGCCTGGTTGTGATGGTGGCAGTTTGTATGTAAATAAACATGCATTCCACACACCAGCTTTTGATAAAAGTGCTTTTGTTAAT |
| TTAAAACAATTACCATTTTTCTATTACTCTGACAGTCCATGTGAGTCTCATGGAAAACAAGTAGTGTCAGATATAGATTATGTACCACTAA |
| AGTCTGCTACGTGTATAACACGTTGCAATTTAGGTGGTGCTGTCTGTAGACATCATGCTAATGAGTACAGATTGTATCTCGATGCTTATA |
| ACATGATGATCTCAGCTGGCTTTAGCTTGTGGGTTTACAAACAATTTGATACTTATAACCTCTGGAACACTTTTACAAGACTTCAGAGTTT |
| AGAAAATGTGGCTTTTAATGTTGTAAATAAGGGACACTTTGATGGACAACAGGGTGAAGTACCAGTTTCTATCATTAATAACACTGTTTA |
| CACAAAAGTTGATGGTGTTGATGTAGAATTGTTTGAAAATAAAACAACATTACCTGTTAATGTAGCATTTGAGCTTTGGGCTAAGCGCAA |
| CATTAAACCAGTACCAGAGGTGAAAATACTCAATAATTTGGGTGTGGACATTGCTGCTAATACTGTGATCTGGGACTACAAAAGAGATG |
| CTCCAGCACATATATCTACTATTGGTGTTTGTTCTATGACTGACATAGCCAAGAAACCAACTGAAACGATTTGTGCACCACTCACTGTCTT |
| TTTTGATGGTAGAGTTGATGGTCAAGTAGACTTATTTAGAAATGCCCGTAATGGTGTTCTTATTACAGAAGGTAGTGTTAAAGGTTTACA |
| ACCATCTGTAGGTCCCAAACAAGCTAGTCTTAATGGAGTCACATTAATTGGAGAAGCCGTAAAAACACAGTTCAATTATTATAAGAAAGT |
| TGATGGTGTTGTCCAACAATTACCTGAAACTTACTTTACTCAGAGTAGAAATTTACAAGAATTTAAACCCAGGAGTCAAATGGAAATTGA |
| TTTCTTAGAATTAGCTATGGATGAATTCATTGAACGGTATAAATTAGAAGGCTATGCCTTCGAACATATCGTTTATGGAGATTTTAGTCAT |
| AGTCAGTTAGGTGGTTTACATCTACTGATTGGACTAGCTAAACGTTTTAAGGAATCACCTTTTGAATTAGAAGATTTTATTCCTATGGACA |
| GTACAGTTAAAAACTATTTCATAACAGATGCGCAAACAGGTTCATCTAAGTGTGTGTGTTCTGTTATTGATTTATTACTTGATGATTTTGTT |
| GAAATAATAAAATCCCAAGATTTATCTGTAGTTTCTAAGGTTGTCAAAGTGACTATTGACTATACAGAAATTTCATTTATGCTTTGGTGTA |
| AAGATGGCCATGTAGAAACATTTTACCCAAAATTACAATCTAGTCAAGCGTGGCAACCGGGTGTTGCTATGCCTAATCTTTACAAAATGC |
| AAAGAATGCTATTAGAAAAGTGTGACCTTCAAAATTATGGTGATAGTGCAACATTACCTAAAGGCATAATGATGAATGTCGCAAAATAT |
| ACTCAACTGTGTCAATATTTAAACACATTAACATTAGCTGTACCCTATAATATGAGAGTTATACATTTTGGTGCTGGTTCTGATAAAGGAG |
| TTGCACCAGGTACAGCTGTTTTAAGACAGTGGTTGCCTACGGGTACGCTGCTTGTCGATTCAGATCTTAATGACTTTGTCTCTGATGCAG |
| ATTCAACTTTGATTGGTGATTGTGCAACTGTACATACAGCTAATAAATGGGATCTCATTATTAGTGATATGTACGACCCTAAGACTAAA |
| ATGTTACAAAAGAAAATGACTCTAAAGAGGGTTTTTTCACTTACATTTGTGGGTTTATACAACAAAAGCTAGCTCTTGGAGGTTCCGTGG |
| CTATAAAGATAACAGAACATTCTTGGAATGCTGATCTTTATAAGCTCATGGGACACTTCGCATGGTGGACAGCCTTTGTTACTAATGTGA |
| ATGCGTCATCATCTGAAGCATTTTTAATTGGATGTAATTATCTTGGCAAACCACGCGAACAAATAGATGGTTATGTCATGCATGCAAATT |
| ACATATTTTGGAGGAATACAAATCCAATTCAGTTGTCTTCCTATTCTTTATTTGACATGAGTAAATTTCCCCTTAAATTAAGGGGTACTGCT |
| GTTATGTCTTTAAAAGAAGGTCAAATCAATGATATGATTTTATCTCTTCTTAGTAAAGGTAGACTTATAATTAGAGAAAACAACAGAGTT |
| GTTATTTCTAGTGATGTTCTTGTTAACAACTAAACGAACAATGTTTGTTTTTCTTGTTTTATTGCCACTAGTCTCTAGTCAGTGTGTTAATCT |
| TACAACCAGAACTCAATTACCCCCTGCATACACTAATTCTTTCACACGTGGTGTTTATTACCCTGACAAAGTTTTCAGATCCTCAGTTTTAC |
| ATTCAACTCAGGACTTGTTCTTACCTTTCTTTTCCAATGTTACTTGGTTCCATGCTATACATGTCTCTGGGACCAATGGTACTAAGAGGTTT |
| GATAACCCTGTCCTACCATTTAATGATGGTGTTTATTTTGCTTCCACTGAGAAGTCTAACATAATAAGAGGCTGGATTTTTGGTACTACTT |
| TAGATTCGAAGACCCAGTCCCTACTTATTGTTAATAACGCTACTAATGTTGTTATTAAAGTCTGTGAATTTCAATTTTGTAATGATCCATTT |
| TTGGGTGTTTATTACCACAAAAACAACAAAAGTTGGATGGAAAGTGAGTTCAGAGTTTATTCTAGTGCGAATAATTGCACTTTTGAATAT |
| GTCTCTCAGCCTTTTCTTATGGACCTTGAAGGAAAACAGGGTAATTTCAAAAATCTTAGGGAATTTGTGTTTAAGAATATTGATGGTTATT |
| TTAAAATATATTCTAAGCACACGCCTATTAATTTAGTGCGTGATCTCCCTCAGGGTTTTTCGGCTTTAGAACCATTGGTAGATTTGCCAAT |
| AGGTATTAACATCACTAGGTTTCAAACTTTACTTGCTTTACATAGAAGTTATTTGACTCCTGGTGATTCTTCTTCAGGTTGGACAGCTGGT |
| GCTGCAGCTTATTATGTGGGTTATCTTCAACCTAGGACTTTTCTATTAAAATATAATGAAATGGAACCATTACAGATGCTGTAGACTGTG |
| CACTTGACCCTCTCTCAGAAACAAAGTGTACGTTGAAATCCTTCACTGTAGAAAAGGAATCTATCAAACTTCTAACTTTAGAGTCCAACC |

| SEQUENCES |
|---|
| AACAGAATCTATTGTTAGATTTCCTAATATTACAAACTTGTGCCCTTTTGGTGAAGTTTTTAACGCCACCAGATTTGCATCTGTTTATGCTT |
| GGAACAGGAAGAGAATCAGCAACTGTGTTGCTGATTATTCTTTCCTATATAATTCCGCATCATTTTCCACTTTTAAGTGTTATGGAGTGTC |
| TCCTACTAAATTAAATGATCTCTGCTTTACTAATGTCTATGCAGATTCATTTGTAATTAGAGGTGATGAAGTCAGACAAATCGCTCCAGGG |
| CAAACTGGAAAGATTGCTGATTATAATTATAAATTACCAGATGATTTTACAGGCTGCGTTATAGCTTGGAATTCTAACAATCTTGATTCTA |
| AGGTTGGTGGTAATTATAATTACCTGTATAGATTGTTTAGGAAGTCTAATCTCAAACCTTTTGAGAGAGATATTTCAACTGAAATCTATCA |
| GGCCGGTAGCACACCTTGTAATGGTGTTGAAGGTTTTAATTGTTACTTTCCTTTACAATCATATGGTTTCCAACCCACTAATGGTGTTGGT |
| TACCAACCATACAGAGTAGTAGTACTTTCTTTTGAACTTCTACATGCACCAGCAACTGTTTGTGGACCTAAAAAGTCTACTAATTTGGTTA |
| AAAACAAATGTGTCAATTTCAACTTCAATGGTTTAACAGGCACAGGTGTTCTTACTGAGTCTAACAAAAAGTTTCTGCCTTTCCAACAATT |
| TGGCAGAGACATTGCTGACACTACTGATGCTGTCCGTGATCCACAGACACTTGAGATTCTTGACATTACACCATGTTCTTTTGGTGGTGTC |
| AGTGTTATAACACCAGGAACAAATACTTCTAACCAGGTTGCTGTTCTTTATCAGGATGTTAACTGCACAGAAGTCCCTGTTGCTATTCATG |
| CAGATCAACTTACTCCTACTTGGCGTGTTTATTCTACAGGTTCTAATGTTTTTCAAACACGTGCAGGCTGTTTAATAGGGGCTGAACATGT |
| CAACAACTCATATGAGTGTGACATACCCATTGGTGCAGGTATATGCGCTAGTTATCAGACTCAGACTAATTCTCCTCGGCGGGCACGTAG |
| TGTAGCTAGTCAATCCATCATTGCCTACACTATGTCACTTGGTGCAGAAAATTCAGTTGCTTACTCTAATAACTCTATTGCCATACCCACA |
| ATTTTACTATTAGTGTTACCACAGAAATTCTACCAGTGTCTATGACCAAGACATCAGTAGATTGTACAATGTACATTTGTGGTGATTCAAC |
| TGAATGCAGCAATCTTTTGTTGCAATATGGCAGTTTTTGTACACAATTAAACCGTGCTTTAACTGGAATAGCTGTTGAACAAGACAAAAA |
| CACCCAAGAAGTTTTTGCACAAGTCAAACAAATTTACAAAACACCACCAATTAAAGATTTTGGTGGTTTTAATTTTTCACAAATATTACCA |
| GATCCATCAAAACCAAGCAAGAGGTCATTTATTGAAGATCTACTTTTCAACAAAGTGACACTTGCAGATGCTGGCTTCATCAAACAATAT |
| GGTGATTGCCTTGGTGATATTGCTGCTAGAGACCTCATTTGTGCACAAAAGTTTAACGGCCTTACTGTTTTGCCACCTTTGCTCACAGATG |
| AAATGATTGCTCAATACACTTCTGCACTGTTAGCGGGTACAATCACTTCTGGTTGGACCTTTGGTGCAGGTGCTGCATTACAAATACCATT |
| TGCTATGCAAATGGCTTATAGGTTTAATGGTATTGGAGTTACACAGAATGTTCTCTATGAGAACCAAAAATTGATTGCCAACCAATTTAA |
| TAGTGCTATTGGCAAAATTCAAGACTCACTTTCTTCCACAGCAAGTGCACTTGGAAAACTTCAAGATGTGGTCAACCAAAATGCACAAGC |
| TTTAAACACGCTTGTTAAACAACTTAGCTCCAATTTTGGTGCAATTTCAAGTGTTTTAAATGATATCCTTTCACGTCTTGACAAAGTTGAG |
| GCTGAAGTGCAAATTGATAGGTTGATCACAGGCAGACTTCAAAGTTTGCAGACATATGTGACTCAACAATTAATTAGAGCTGCAGAAAT |
| CAGAGCTTCTGCTAATCTTGCTGCTACTAAAATGTCAGAGTGTGTACTTGGACAATCAAAAAGAGTTGATTTTTGTGGAAAGGGCTATCA |
| TCTTATGTCCTTCCCTCAGTCAGCACCTCATGGTGTAGTCTTCTTGCATGTGACTTATGTCCCTGCACAAGAAAAGAACTTCACAACTGCTC |
| CTGCCATTTGTCATGATGGAAAAGCACACTTTCCTCGTGAAGGTGTCTTTGTTTCAAATGGCACACACTGGTTTGTAACACAAAGGAATT |
| TTTATGAACCACAAATCATTACTACAGACAACACATTTGTGTCTGGTAACTGTGATGTTGTAATAGGAATTGTCAACAACACAGTTTATGA |
| TCCTTTGCAACCTGAATTAGACTCATTCAAGGAGGAGTTAGATAAATATTTTAAGAATCATACATCACCAGATGTTGATTTAGGTGACATC |
| TCTGGCATTAATGCTTCAGTTGTAAACATTCAAAAAGAAATTGACCGCCTCAATGAGGTTGCCAAGAATTTAAATGAATCTCTCATCGATC |
| TCCAAGAACTTGGAAAGTATGAGCAGTATATAAAATGGCCATGGTACATTTGGCTAGGTTTTATAGCTGGCTTGATTGCCATAGTAATG |
| GTGACAATTATGCTTTGCTGTATGACCAGTTGCTGTAGTTGTCTCAAGGGCTGTTGTTCTTGTGGATCCTGCTGCAAATTTGATGAAGAC |
| GACTCTGAGCCAGTGCTCAAAGGAGTCAAATTACATTACACATAAACGAACTTATGGATTTGTTTATGAGAATCTTCACAATTGGAACTG |
| TAACTTTGAAGCAAGGTGAAATCAAGGATGCTACTCCTTCAGATTTGTTCGCGCTACTGCAACGATACCGATACAAGCCTCACTCCCTTT |
| CGGATGGCTTATTGTTGGCGTTGCACTTCTTGCTGTTTTTCAGAGCGCTTCCAAAATCATAACCCTCAAAAAGAGATGGCAACTAGCACT |
| CTCCAAGGGTGTTCACTTTGTTTGCAACTTGCTGTTGTTGTTTGTAACAGTTTACTCACACCTTTTGCTCGTTGCTGCTGGCCTTGAAGCCC |
| CTTTTCTCTATCTTTATGCTTTAGTCTACTTCTTGCAGAGTATAAACTTTGTAAGAATAATAATGAGGCTTTGGCTTTGCTGGAAATGCCGT |
| TCCAAAAACCCATTACTTTATGATGCCAACTATTTTCTTTGCTGGCATACTAATTGTTACGACTATTGTATACCTTACAATAGTGTAACTTCT |
| TCAATTGTCATTACTTCAGGTGATGGCACAACAAGTCCTATTTCTGAACATGACTACCAGATTGGTGGTTATACTGAAAAATGGGAATCT |

| SEQUENCES |
|---|
| GGAGTAAAAGACTGTGTTGTATTACACAGTTACTTCACTTCAGACTATTACCAGCTGTACTCAACTCAATTGAGTACAGACACTGGTGTT |
| GAACATGTTACCTTCTTCATCTACAATAAAATTGTTGATGAGCCTGAAGAACATGTCCAAATTCACACAATCGACGTTTCATCCGGAGTTG |
| TTAATCCAGTAATGGAACCAATTTATGATGAACCGACGACGACTACTAGCGTGCCTTTGTAAGCACAAGCTGATGAGTACGAACTTATGT |
| ACTCATTCGTTTCGGAAGAGACAGGTACGTTAATAGTTAATAGCGTACTTCTTTTTCTTGCTTTCGTGGTATTCTTGCTAGTTACACTAGCC |
| ATCCTTACTGCGCTTCGATTGTGTGCGTACTGCTGCAATATTGTTAACGTGAGTCTTGTAAAACCTTCTTTTTACGTTTACTCTCGTGTTAA |
| AAATCTGAATTCTTCTAGAGTTCCTGATCTTCTGGTCTAAACGAACTAAATATTATATTAGTTTTTCTGTTTGGAACTTTAATTTTAGCCAT |
| GGCAGATTCCAACGGTACTATTACCGTTGAAGAGCTTAAAAAGCTCCTTGAACAATGGAACCTAGTAATAGGTTTCCTATTCCTTACATG |
| GATTTGTCTTCTACAATTTGCCTATGCCAACAGGAATAGGTTTTTGTATATAATTAAGTTAATTTTCCTCTGGCTGTTATGGCCAGTAACTT |
| TAGCTTGTTTTGTGCTTGCTGCTGTTTACAGAATAAATTGGATCACCGGTGGAATTGCTATCGCAATGGCTTGTCTTGTAGGCTTGATGTG |
| GCTCAGCTACTTCATTGCTTCTTTCAGACTGTTTGCGCGTACGCGTTCCATGTGGTCATTCAATCCAGAAACTAACATTCTTCTCAACGTGC |
| CACTCCATGGCACTATTCTGACCAGACCGCTTCTAGAAAGTGAACTCGTAATCGGAGCTGTGATCCTCGTGGACATCTTCGTATTGCTG |
| GACACCATCTAGGACGCTGTGACATCAAGGACCTGCCTAAAGAAATCACTGTTGCTACATCACGAACGCTTTCTTATTACAAATTGGGAG |
| CTTCGCAGCGTGTAGCAGGTGACTCAGGTTTTGCTGCATACAGTCGCTACAGGATTGGCAACTATAAATTAAACACAGACCATTCCAGTA |
| GCAGTGACAATATTGCTTTGCTTGTACAGTAAGTGACAACAGATGTTTCATCTCGTTGACTTTCAGGTTACTATAGCAGAGATATTACTAA |
| TTATTATGAGGACTTTTAAAGTTTCCATTTGGAATCTTGATTACATCATAAACCTCATAATTAAAAATTTATCTAAGTCACTAACTGAGAAT |
| AAATATTCTCAATTAGATGAAGAGCAACCAATGGAGATTGATTAAACGAACATGAAAATTATTCTTTTCTTGGCACTGATAACACTCGCT |
| ACTTGTGAGCTTTATCACTACCAAGAGTGTGTTAGAGGTACAACAGTACTTTTAAAAGAACCTTGCTCTTCTGGAACATACGAGGGCAAT |
| TCACCATTTCATCCTCAGCTGATAACAAATTTGCACTGACTTGCTTTAGCACTCAATTTGCTTTTGCTTGTCCTGACGGCGTAAAACACGT |
| CTATCAGTTACGTGCCAGATCAGTTTCACCTAAACTGTTCATCAGACAAGAGGAAGTTCAAGAACTTTACTCTCCAATTTTTCTTATTGTTG |
| CGGCAATAGTGTTTATAACACTTTGCTTCACACTCAAAAGAAAGACAGAATGATTGAACTTTCATTAATTGACTTCTATTTGTGCTTTTTA |
| GCCTTTCTGCTATTCCTTGTTTTAATTATGCTTATTATCTTTTGGTTCTCACTTGAACTGCAAGATCATAATGAAACTTGTCACGCCTAAACG |
| AACATGAAATTTCTTGTTTTCTTAGGAATCATCACAACTGTAGCTGCATTTCACCAAGAATGTAGTTTACAGTCATGTACTCAACATCAAC |
| CATATGTAGTTGATGACCCGTGTCCTATTCACTTCTATTCTAAATGGTATATTAGAGTAGGAGCTAGAAAATCAGCACCTTTAATTGAATT |
| GTGCGTGGATGAGGCTGGTTCTAAATCACCCATTCAGTACATCGATATCGGTAATTATACAGTTTCCTGTTTACCTTTTACAATTAATTGC |
| CAGGAACCTAAATTGGGTAGTCTTGTAGTGCGTTGTTCGTTCTATGAAGACTTTTTAGAGTATCATGACGTTCGTGTTGTTTTAGATTTCA |
| TCTAAACGAACAAACTAAAATGTCTGATAATGGACCCCAAAATCAGCGAAATGCACCCCGCATTACGTTTGGTGGACCCTCAGATTCAAC |
| TGGCAGTAACCAGAATGGAGAACGCAGTGGGGCGCGATCAAAACAACGTCGGCCCCAAGGTTTACCCAATAATACTGCGTCTTGGTTC |
| ACCGCTCTCACTCAACATGGCAAGGAAGACCTTAAATTCCCTCGAGGACAAGGCGTTCCAATTAACACCAATAGCAGTCCAGATGACCA |
| AATTGGCTACTACCGAAGAGCTACCAGACGAATTCGTGGTGGTGACGGTAAAATGAAAGATCTCAGTCCAAGATGGTATTTCTACTACC |
| TAGGAACTGGGCCAGAAGCTGGACTTCCCTATGGTGCTAACAAAGACGGCATCATATGGGTTGCAACTGAGGGAGCCTTGAATACACC |
| AAAAGATCACATTGGCACCCGCAATCCTGCTAACAATGCTGCAATCGTGCTACAACTTCCTCAAGGAACAACATTGCCAAAAGGCTTCTA |
| CGCAGAAGGGAGCAGAGGCGGCAGTCAAGCCTCTTCTCGTTCCTCATCACGTAGTCGCAACAGTTCAAGAAATTCAACTCCAGGCAGCA |
| GTAGGGGAACTTCTCCTGCTAGAATGGCTGGCAATGGCGGTGATGCTGCTCTTGCTTTGCTGCTGCTTGACAGATTGAACCAGCTTGAG |
| AGCAAAATGTCTGGTAAAGGCCAACAACAACAAGGCCAAACTGTCACTAAGAAATCTGCTGCTGAGGCTTCTAAGAAGCCTCGGCAAA |
| AACGTACTGCCACTAAAGCATACAATGTAACACAAGCTTTCGGCAGACGTGGTCCAGAACAAACCCAAGGAAATTTTGGGGACCAGGA |
| ACTAATCAGACAAGGAACTGATTACAAACATTGGCCGCAAATTGCACAATTTGCCCCCAGCGCTTCAGCGTTCTTCGGAATGTCGCGCAT |
| TGGCATGGAAGTCACACCTTCGGGAACGTGGTTGACCTACACAGGTGCCATCAAATTGGATGACAAAGATCCAAATTTCAAAGATCAAG |
| TCATTTTGCTGAATAAGCATATTGACGCATACAAAACATTCCCACCAACAGAGCCTAAAAAGGACAAAAAGAAGAAGGCTGATGAAACT |
| CAAGCCTTACCGCAGAGACAGAAGAAACAGCAAACTGTGACTCTTCTTCCTGCTGCAGATTTGGATGATTTCTCCAAACAATTGCAACAA |

| SEQUENCES |
|---|

TCCATGAGCAGTGCTGACTCAACTCAGGCCTAAACTCATGCAGACCACACAAGGCAGATGGGCTATATAAACGTTTTCGCTTTTCCGTTT

ACGATATATAGTCTACTCTTGTGCAGAATGAATTCTCGTAACTACATAGCACAAGTAGATGTAGTTAACTTTAATCTCACATAGCAATCTT

TAATCAGTGTGTAACATTAGGGAGGACTTGAAAGAGCCACCACATTTTCACCGAGGCCACGCGGAGTACGATCGAGTGTACAGTGAAC

AATGCTAGGGAGAGCTGCCTATATGGAAGAGCCCTAATGTGTAAAATTAATTTTAGTAGTGCTATCCCCATGTGATTTTAATAGCTTCTT

AGGAGAATGACAAAA

>Severe acute respiratory syndrome coronavirus 2 orf1ab polyprotein of isolate hCoV-19/France/
IDF0372-isI/2020

SEQ ID NO: 13

MESLVPGFNEKTHVQLSLPVLQVRDVLVRGFGDSVEEVLSEARQHLKDGTCGLVEVEKGVLPQLEQPYVFIKRSDARTAPHGHVMVELVAELE

GIQYGRSGETLGVLVPHVGEIPVAYRKYLLRKNGNKGAGGHSYGADLKSFDLGDELGTDPYEDFQENWNTKHSSGVTRELMRELNGGAYTRY

VDNNFCGPDGYPLECIKDLLARAGKASCTLSEQLDFIDTKRGVYCCREHEHEIAWYTERSEKSYELQTPFEIKLAKKFDTFNGECPNFVFPLNSIIK

TIQPRVEKKKLDGFMGRIRSVYPVASPNECNQMCLSTLMKCDHCGETSWQTGDFVKATCEFCGTENLTKEGATTCGYLPQNAVVKIYCPACH

NSEVGPEHSLAEYHNESGLKTILRKGGRTIAFGGCVFSYVGCHNKCAYWVPRASANIGCNHTGVVGEGSEGLNDNLLEILQKEKVNINIVGDFK

LNEEIAIILASFSASTSAFVETVKGLDYKAFKQIVESCGNFKVTKGKAKKGAWNIGEQKSILSPLYAFASEAARVVRSIFSRTLETAQNSVRVLQKA

AITILDGISQYSLRLIDAMMFTSDLATNNLVVMAYITGGVVQLTSQWLTNIFGTVYEKLKPVLDWLEEKFKEGVEFLRDGWEIVKFISTCACEIV

GGQIVTCAKEIKESVQTFFKLVNKFLALCADSIIIGGAKLKALNLGETFVTHSKGLYRKCVKSREETGLLMPLKAPKEIIFLEGETLPTEVLTEEVVLK

TGDLQPLEQPTSEAVEAPLVGTPVCINGLMLLEIKDTEKYCALAPNMMVTNNTFTLKGGAPTKVTFGDDTVIEVQGYKSVNITFELDERIDKVL

NEKCSAYTVELGTEVNEFACVVADAVIKTLQPVSELLTPLGIDLDEWSMATYYLFDESGEFKLASHMYCSFYPPDEDEEEGDCEEEEFEPSTQYE

YGTEDDYQGKPLEFGATSAALQPEEEQEEDWLDDDSQQTVGQQDGSEDNQTTTIQTIVEVQPQLEMELTPVVQTIEVNSFSGYLKLTDNVYI

KNADIVEEAKKVKPTVVVNAANVYLKHGGGVAGALNKATNNAMQVESDDYIATNGPLKVGGSCVLSGHNLAKHCLHVVGPNVNKGEDIQL

LKSAYENFNQHEVLLAPLLSAGIFGADPIHSLRVCVDTVRTNVYLAVFDKNLYDKLVSSFLEMKSEKQVEQKIAEIPKEEVKPFITESKPSVEQRKQ

DDKKIKACVEEVTTTLEETKFLTENLLLYIDINGNLHPDSATLVSDIDITFLKKDAPYIVGDVVQEGVLTAVVIPTKKAGGTTEMLAKALRKVPTDN

YITTYPGQGLNGYTVEEAKTVLKKCKSAFYILPSIISNEKQEILGTVSWNLREMLAHAEETRKLMPVCVETKAIVSTIQRKYKGIKIQEGVVDYGAR

FYFYTSKTTVASLINTLNDLNETLVTMPLGYVTHGLNLEEAARYMRSLKVPATVSVSSPDAVTAYNGYLTSSSKTPEEHFIETISLAGSYKDWSYS

GQSTQLGIEFLKRGDKSVYYTSNPTTFHLDGEVITFDNLKTLLSLREVRTIKVFTTVDNINLHTQVVDMSMTYGQQFGPTYLDGADVTKIKPHNS

HEGKTFYYLPNDDTLRVEAFEYYHTTDPSFLGRYMSALNHTKKWKYPQVNGLTSIKWADNNCYLATALLTLQQIELKFNPPALQDAYYRARAG

EAANFCALILAYCNKTVGELGDVRETMSYLFQHANLDSCKRYLNYVCKTCGQQQTTLKGVEAVMYMGTLSYEQFKKGVQIPCTCGKQATKYL

VQQESPFVMMSAPPAQYELKHGTFTCASEYTGNYQCGHYKHITSKETLYCIDGALLTKSSEYKGPITDVFYKENSYTTTIKPVTYKLDGVVCTEID

PKLDNYYKKDNSYFTEQPIDLVPNQPYPNASFDNFKFVCDNIKFADDLNQLTGYKKPASRELKVTFFPDLNGDVVAIDYKHYTPSFKKGAKLLHK

PIVWHVNNATNKATYKPNTWCIRCLWSTKPVETSNSFDVLKSEDAQGMDNLACEDLKPVSEEVVENPTIQKDVLECNVKTTEVVGDIILKPAN

NSLKITEEVGHTDLMAAYVDNSSLTIKKPNELSRVLGLKTLATHGLAAVNSVPWDTIANYAKPFLNKVVSTTTNIVTRCLNRVCTNYMPYFFTLL

LQLCTFTRSTNSRIKASMPTTIAKNTVKSVGKFCLEASFNYLKSPNFSKLINIIIWFLLLSVCLGSLIYSTAALGVLMSNLGMPSYCTGYREGYLNST

NVTIATYCTGSIPCSVCLSGLDSLDTYPSLETIQITISSFKWDLTAFGLVAEWFLAYILFTRFFYYLGLAAIMQLFFSYFAVHFISNSWLMWLIINLV

QMAPISAMVRMYIFFASFYYVWKSYVHVVDGCNSSTCMMCYKRNRATRVECTTIVNGVRRSFYVYANGGKGFCKLHNWNCVNCDTFCAG

STFISDEVARDLSLQFKRPINPTDQSSYIVDSVTVKNGSIHLYFDKAGQKTYERHSLSHFVNLDNLRANNTKGSLPINVIVFDGKSKCEESSAKSAS

VYYSQLMCQPILLLDQALVSDVGDSAEVAVKMFDAYVNTFSSTFNVPMEKLKTLVATAEAELAKNVSLDNVLSTFISAARQGFVDSDVETKDV

VECLKLSHQSDIEVTGDSCNNYMLTYNKVENMTPRDLGACIDCSARHINAQVAKSHNIALIWNVKDFMSLSEQLRKQIRSAAKKNNLPFKLTC

ATTRQVVNVYTTKIALKGGKIVNNWLKQLIKVTLVFLFVAAIFYLITPVHVMSKHTDFSSEIIGYKAIDGGVTRDIASTDTCFANKHADFDTWFS

QRGGSYTNDKACPLIAAVITREVGFVVPGLPGTILRTTNGDFLHFLPRVFSAVGNICYTPSKLIEYTDFATSACVLAAECTIFKDASGKPVPYCYDT

NVLEGSVAYESLRPDTRYVLMDGSIIQFPNTYLEGSVRVVTTFDSEYCRHGTCERSEAGVCVSTSGRWVLNNDYYRSLPGVFCGVDAVNLLTN

| SEQUENCES |
|---|
| MFTPLIQPIGALDISASIVAGGIVAIVVTCLAYYFMRFRRAFGEYSHVVAFNTLLFLMSFTVLCLTPVYSFLPGVYSVIYLYLTFYLTNDVSFLAHIQ |
| WMVMFTPLVPFWITIAYIICISTKHFYWFFSNYLKRRVVFNGVSFSTFEEAALCTFLLNKEMYLKLRSDYLLPLTQYNRYLALYNKYKYFSGAMD |
| TTSYREAACCHLAKALNDFSNSGSDVLYQPPQTSITSAVLQSGFRKMAFPSGKVEGCMVQVTCGTTTLNGLWLDDVVYCPRHVICTSEDMLN |
| PNYEDLLIRKSNHNFLVQAGNVQLRVIGHSMQNCVLKLKVDTANPKTPKYKFVRIQPGQTFSVLACYNGSPSGVYQCAMRPNFTIKGSFLNGS |
| CGSVGFNIDYDCVSFCYMHHMELPTGVHAGTDLEGNFYGPFVDRQTAQAAGTDTTITVNVLAWLYAAVINGDRWFLNRFTTTLNDFNLVA |
| MKYNYEPLTQDHVDILGPLSAQTGIAVLDMCASLKELLQNGMNGRTILGSALLEDEFTPFDVVRQCSGVTFQSAVKRTIKGTHHWLLLTILTSL |
| LVLVQSTQWSLFFFLYENAFLPFAMGIIAMSAFAMMFVKHKHAFLCLFLLPSLATVAYFNMVYMPASWVMRIMTWLDMVDTSLSGFKLKD |
| CVMYASAVVLLILMTARTVYDDGARRVWTLMNVLTLVYKVYYGNALDQAISMWALIISVTSNYSGVVTTVMFLARGIVFMCVEYCPIFFITGN |
| TLQCIMLVYCFLGYFCTCYFGLFCLLNRYFRLTLGVYDYLVSTQEFRYMNSQGLLPPKNSIDAFKLNIKLLGVGGKPCIKVATVQSKMSDVKCTSV |
| VLLSVLQQLRVESSSKLWAQCVQLHNDILLAKDTTEAFEKMVSLLSVLLSMQGAVDINKLCEEMLDNRATLQAIASEFSSLPSYAAFATAQEAY |
| EQAVANGDSEVVLKKLKKSLNVAKSEFDRDAAMQRKLEKMADQAMTQMYKQARSEDKRAKVTSAMQTMLFTMLRKLDNDALNNIINNA |
| RDGCVPLNIIPLTTAAKLMVVIPDYNTYKNTCDGTTFTYASALWEIQQVVDADSKIVQLSEISMDNSPNLAWPLIVTALRANSAVKLQNNELSP |
| VALRQMSCAAGTTQTACTDDNALAYYNTTKGGRFVLALLSDLQDLKWARFPKSDGTGTIYTELEPPCRFVTDTPKGPKVKYLYFIKGLNNLNR |
| GMVLGSLAATVRLQAGNATEVPANSTVLSFCAFAVDAAKAYKDYLASGGQPITNCVKMLCTHTGTGQAITVTPEANMDQESFGGASCCLYC |
| RCHIDHPNPKGFCDLKGKYVQIPTTCANDPVGFTLKNTVCTVCGMWKGYGCSCDQLREPMLQSADAQSFLNGFAV |
| >Protein\S_Human\2019-nCoV (Sprotein_hCoV19FranceIDF0372isI2020) SEQ ID NO: 14 |
| MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFAS |
| TEKSNIIRGWIFGTTLDSKTQSLLIVNNATNVVIKVCEFQFCNDPFLGVYYHKNNKSWMESEFRVYSSANNCTFEYVSQPFLMDLEGKQGNFK |
| NLREFVFKNIDGYFKIYSKHTPINLVRDLPQGFSALEPLVDLPIGINITRFQTLLALHRSYLTPGDSSSGWTAGAAAYYVGYLQPRTFLLKYNENGT |
| ITDAVDCALDPLSETKCTLKSFTVEKGIYQTSNFRVQPTESIVRFPNITNLCPFGEVFNATRFASVYAWNRKRISNCVADYSFLYNSASFSTFKCYG |
| VSPTKLNDLCFTNVYADSFVIRGDEVRQIAPGQTGKIADYNYKLPDDFTGCVIAWNSNNLDSKVGGNYNYLYRLFRKSNLKPFERDISTEIYQAG |
| STPCNGVEGFNCYFPLQSYGFQPTNGVGYQPYRVVVLSFELLHAPATVCGPKKSTNLVKNKCVNFNFNGLTGTGVLTESNKKFLPFQQFGRDI |
| ADTTDAVRDPQTLEILDITPCSFGGVSVITPGTNTSNQVAVLYQDVNCTEVPVAIHADQLTPTWRVYSTGSNVFQTRAGCLIGAEHVNNSYEC |
| DIPIGAGICASYQTQTNSPRRARSVASQSIIAYTMSLGAENSVAYSNNSIAIPTNFTISVTTEILPVSMTKTSVDCTMYICGDSTECSNLLLQYGSF |
| CTQLNRALTGIAVEQDKNTQEVFAQVKQIYKTPPIKDFGGFNFSQILPDPSKPSKRSFIEDLLFNKVTLADAGFIKQYGDCLGDIAARDLICAQKF |
| NGLTVLPPLLTDEMIAQYTSALLAGTITSGWTFGAGAALQIPFAMQMAYRFNGIGVTQNVLYENQKLIANQFNSAIGKIQDSLSSTASALGKLQ |
| DVVNQNAQALNTLVKQLSSNFGAISSVLNDILSRLDKVEAEVQIDRLITGRLQSLQTYVTQQLIRAAEIRASANLAATKMSECVLGQSKRVDFC |
| GKGYHLMSFPQSAPHGVVFLHVTYVPAQEKNFTTAPAICHDGKAHFPREGVFVSNGTHWFVTQRNFYEPQIITTDNTFVSGNCDVVIGIVNN |
| TVYDPLQPELDSFKEELDKYFKNHTSPDVDLGDISGINASVVNIQKEIDRLNEVAKNLNESLIDLQELGKYEQYIKWPWYIWLGFIAGLIAIVMVT |
| IMLCCMTSCCSCLKGCCSCGSCCKFDEDDSEPVLKGVKLHYT |
| >hCoV-19/Austria/CeMM0360/2020\|EPI_ISL_438123\|2020-04-05 SEQ ID NO: 15 |
| NNNNNNNNNNNNNNNNNNNNNNNNNNNNNNNNNACCAACCAACTTTCGATCTCTTGTAGATCTGTTCTCTAAACGAACTTTAAAATCTG |
| TGTGGCTGTCACTCGGCTGCATGCTTAGTGCACTCACGCAGTATAATTAATAACTAATTACTGTCGTTGACAGGACACGAGTAACTCGTC |
| TATCTTCTGCAGGCTGCTTACGGTTTCGTCCGTGTTGCAGCCGATCATCAGCACATCTAGGTTTTGTCCGGGTGTGACCGAAAGGTAAGA |
| TGGAGAGCCTTGTCCCTGGTTTCAACGAGAAAACACACGTCCAACTCAGTTTGCCTGTTTTACAGGTTCGCGACGTGCTCGTACGTGGCT |
| TTGGAGACTCCGTGGAGGAGGTCTTATCAGAGGCACGTCAACATCTTAAAGATGGCACTTGTGGCTTAGTAGAAGTTGAAAAAGGCGT |
| TTTGCCTCAACTTGAACAGCCCTATGTGTTCATCAAACGTTCGGATGCTCGAACTGCACCTCATGGTCATGTTATGGTTGAGCTGGTAGC |
| AGAACTCGAAGGCATTCAGTACGGTCGTAGTGGTGAGACACTTGGTGTCCTTGTCCCTCATGTGGGCGAAATACCAGTGGCTTACCGCA |

-continued

| SEQUENCES |
|---|
| AGGTTCTTCTTCGTAAGAACGGTAATAAAGGAGCTGGTGGCCATAGTTACGGCGCCGATCTAAAGTCATTTGACTTAGGCGACGAGCTT |
| GGCACTGATCCTTATGAAGATTTTCAAGAAAACTGGAACACTAAACATAGCAGTGGTGTTACCCGTGAACTCATGCGTGAGCTTAACGG |
| AGGGGCATACACTCGCTATGTCGATAACAACTTCTGTGGCCCTGATGGCTACCCTCTTGAGTGCATTAAAGACCTTCTAGCACGTGCTGG |
| TAAAGCTTCATGCACTTTGTCCGAACAACTGGACTTTATTGACACTAAGAGGGGTGTATACTGCTGCCGTGAACATGAGCATGAAATTGC |
| TTGGTACACGGAACGTTCTGAAAAGAGCTATGAATTGCAGACACCTTTTGAAATTAAATTGGCAAAGAAATTTGACACCTTCAATGGGG |
| AATGTCCAAATTTTGTATTTCCCTTAAATTCCATAATCAAGACTATTCAACCAAGGGTTGAAAAGAAAAAGCTTGATGGCTTTATGGGTA |
| GAATTCGATCTGTCTATCCAGTTGCGTCACCAAATGAATGCAACCAAATGTGCCTTTCAACTCTCATGAAGTGTGATCATTGTGGTGAAA |
| CTTCATGGCAGACGGGCGATTTTGTTAAAGCCACTTGCGAATTTTGTGGCACTGAGAATTTGACTAAAGAAGGTGCCACTACTTGTGGTT |
| ACTTACCCCAAAATGCTGTTGTTAAAATTTATTGTCCAGCATGTCACAATTCAGAAGTAGGACCTGAGCATAGTCTTGCCGAATACCATAA |
| TGAATCTGGCTTGAAAACCATTCTTCGTAAGGGTGGTCGCACTATTGCCTTTGGAGGCTGTGTGTTCTCTTATGTTGGTTGCCATAACAA |
| GTGTGCCTATTGGGTTCCACGTGCTAGCGCTAACATAGGTTGTAACCATACAGGTGTTGTTGGAGAAGGTTCCGAAGGTCTTAATGACA |
| ACCTTCTTGAAATACTCCAAAAAGAGAAAGTCAACATCAATATTGTTGGTGACTTTAAACTTAATGAAGAGATCGCCATTATTTGGCATC |
| TTTTTCTGCTTCCACAAGTGCTTTTGTGGAAACTGTGAAAGGTTTGGATTATAAAGCATTCAAACAAATTGTTGAATCCTGTGGTAATTTT |
| AAAGTTACAAAAGGAAAAGCTAAAAAAGGTGCCTGGAATATTGGTGAACAGAAATCAATACTGAGTCCTCTTTATGCATTTGCATCAGA |
| GGCTGCTCGTGTTGTACGATCAATTTTCTCCCGCACTCTTGAAACTGCTCAAAATTCTGTGCGTGTTTTACAGAAGGCCGCTATAACAATA |
| CTAGATGGAATTTCACAGTATTCACTGAGACTCATTGATGCTATGATGTTCACATCTGATTTGGCTACTAACAATCTAGTTGTAATGGCCT |
| ACATTACAGGTGGTGTTGTTCAGTTGACTTCGCAGTGGCTAACTAACATCTTTGGCACTGTTTATGAAAAACTCAAACCCGTCCTTGATTG |
| GCTTGAAGAAGTTTAAGGAAGGTGTAGAGTTTCTTAGAGACGGTTGGGAAATTGTTAAATTTATCTCAACCTGTGCTTGTGAAA |
| TTGTCGGTGGACAAATTGTCACCTGTGCAAAGGAAATTAAGGAGAGTGTTCAGACATTCTTTAAGCTTGTAAATAAATTTTTGGCTTTGT |
| GTGCTGACTCTATCATTATTGGTGGAGCTAAACTTAAAGCCTTGAATTTAGGTGAAACATTTGTCACGCACTCAAAGGGATTGTACAGAA |
| AGTGTGTTAAATCCAGAGAAGAAACTGGCCTACTCATGCCTCTAAAAGCCCCAAAAGAAATTATCTTCTTAGAGGGAGAAACACTTCCCA |
| CAGAAGTGTTAACAGAGGAAGTTGTCTTGAAAACTGGTGATTTACAACCATTAGAACAACCTACTAGTGAAGCTGTTGAAGCTCCATTG |
| GTTGGTACACCAGTTTGTATTAACGGGCTTATGTTGCTCGAAATCAAAGACACAGAAAAGTACTGTGCCCTTGCACCTAATATGATGGTA |
| ACAAACAATACCTTCACACTCAAAGGCGGTGCACCAACAAAGGTTACTTTTGGTGATGACACTGTGATAGAAGTGCAAGGTTACAAGAG |
| TGTGAATATCACTTTTGAACTTGATGAAAGGATTGATAAAGTACTTAATGAGAAGTGCTCTGCCTATACAGTTGAACTCGGTACAGAAGT |
| AAATGAGTTCGCCTGTGTTGTGGCAGATGCTGTCATAAAAACTTTGCAACCAGTATCTGAATTACTTACACCACTGGGCATTGATTTAGA |
| TGAGTGGAGTATGGCTACATACTACTTATTTGATGAGTCTGGTGAGTTTAAATTGGCTTCACATATGTATTGTTCTTTTTACCCTCCAGAT |
| GAGGATGAAGAAGAAGGTGATTGTGAAGAAGAAGAGTTTGAGCCATCAACTCAATATGAGTATGGTACTGAAGATGATTACCAAGGTA |
| AACCTTTGGAATTTGGTGCCACTTCTGCTGCTCTTCAACCTGAAGAAGAGCAAGAAGAAGATTGGTTAGATGATGATAGTCAACAAACT |
| GTTGGTCAACAAGACGGCAGTGAGGACAATCAGACAACTACTATTCAAACAATTGTTGAGGTTCAACCTCAATTAGAGATGGAACTTAC |
| ACCAGTTGTTCAGACTATTGAAGTGAATAGTTTTAGTGGTTATTTAAAACTTACTGACAATGTATACATTAAAAATGCAGACATTGTGGA |
| AGAAGCTAAAAAGGTAAAACCAACAGTGGTTGTTAATGCAGCCAATGTTTACCTTAAACATGGAGGAGGTGTTGCAGGAGCCTTAAATA |
| AGGCTACTAACAATGCCATGCAAGTTGAATCTGATGATTACATAGCTACTAATGGACCACTTAAAGTGGGTGGTAGTTGTGTTTTAAGCG |
| GACACAATCTTGCTAAACACTGTCTTCATGTTGTCGGCCCAAATGTTAACAAAGGTGAAGACATTCAACTTCTTAAGAGTGCTTATGAAA |
| ATTTTAATCAGCACGAAGTTCTACTTGCACCATTATTATCAGCTGGTATTTTTGGTGCTGACCCTATACATTCTTTAAGAGTTTGTGTAGAT |
| ACTGTTCGCACAAATGTCTACTTAGCTGTCTTTGATAAAAATCTCTATGACAAACTTGTTTCAAGCTTTTTGGAAATGAAGAGTGAAAAGC |
| AAGTTGAACAAAAGATCGCTGAGATTCCTAAAGAGGAAGTTAAGCCATTTATAACTGAAAGTAAACCTTCAGTTGAACAGAGAAAACAA |
| GATGATAAGAAAATCAAAGCTTGTGTTGAAGAAGTTACAACAACTCTGGAAGAAACTAAGTTCCTCACAGAAAACTTGTTACTTTATATT |
| GACATTAATGGCAATCTTCATCCAGATTCTGCCACTCTTGTTAGTGACATTGACATCACTTTCTTAAAGAAAGATGCTCCATATATAGTGG |

| SEQUENCES |
|---|
| GTGATGTTGTTCAAGAGGGTGTTTTAACTGCTGTGGTTATACCTACTAAAAAGGCTGGTGGCACTACTGAAATGCTAGCGAAAGCTTTG |
| AGAAAAGTGCCAACAGACAATTATATAACCACTTACCCGGGTCAGGGTTTAAATGGTTACACTGTAGAGGAGGCAAAGACAGTGCTTAA |
| AAAGTGTAAAAGTGCCTTTTACATTCTACCATCTATTATCTCTAATGAGAAGCAAGAAATTCTTGGAACTGTTTCTTGGAATTTGCGAGAA |
| ATGCTTGCACATGCAGAAGAAACACGCAAATTAATGCCTGTCTGTGTGGAAACTAAAGCCATAGTTTCAACTATACAGCGTAAATATAA |
| GGGTATTAAAATACAAGAGGGTGTGGTTGATTATGGTGCTAGATTTTACTTTTACACCAGTAAAACAACTGTAGCGTCACTTATCAACAC |
| ACTTAACGATCTAAATGAAACTCTTGTTACAATGCCACTTGGCTATGTAACACATGGCTTAAATTTGGAAGAAGCTGCTCGGTATATGAG |
| ATCTCTCAAAGTGCCAGCTACAGTTTCTGTTTCTTCACCTGATGCTGTTACAGCGTATAATGGTTATCTTACTTCTTCTTCTAAAACACCTG |
| AAGAACATTTTATTGAAACCATCTCACTTGCTGGTTCCTATAAAGATTGGTCCTATTCTGGACAATCTACACAACTAGGTATAGAATTTCT |
| TAAGAGAGGTGATAAAAGTGTATATTACACTAGTAATCCTACCACATTCCACCTAGATGGTGAAGTTATCACCTTTGACAATCTTAAGAC |
| ACTTCTTTCTTTGAGAGAAGTGAGGACTATTAAGGTGTTTACAACAGTAGACAACATTAACCTCCACACGCAAGTTGTGGACATGTCAAT |
| GACATATGGACAACAGTTTGGTCCAACTTATTGGATGGAGCTGATGTTACTAAAATAAAACCTCATAATTCACATGAAGGTAAAACATT |
| TTATGTTTTACCTAATGATGACACTCTACGTGTTGAGGCTTTTGAGTACTACCACACAACTGATCCTAGTTTTCTGGGTAGGTACATGTCA |
| GCATTAAATCACACTAAAAAGTGGAAATACCCACAAGTTAATGGTTTAACTTCTATTAAATGGGCAGATAACAACTGTTATCTTGCCACT |
| GCATTGTTAACACTCCAACAAATAGAGTTGAAGTTTAATCCACCTGCTCTACAAGATGCTTATTACAGAGCAAGGGCTGGTGAAGCTGCT |
| AACTTTTGTGCACTTATCTTAGCCTACTGTAATAAGACAGTAGGTGAGTTAGGTGATGTTAGAGAAACAATGAGTTACTTGTTTCAACAT |
| GCCAATTTAGATTCTTGCAAAAGAGTCTTGAACGTGGTGTGTAAAACTTGTGGACAACAGCAGACAACCCTTAAGGGTGTAGAAGCTGT |
| TATGTACATGGGCACACTTTCTTATGAACAATTTAAGAAAGGTGTTCAGATACCTTGTACGTGTGGTAAACAAGCTACAAAATATCTAGT |
| ACAACAGGAGTCACCTTTTGTTATGATGTCAGCACCACCTGCTCAGTATGAACTTAAGCATGGTACATTTACTTGTGCTAGTGAGTACACT |
| GGTAATTACCAGTGTGGTCACTATAAACATATAACTTCTAAAGAAACTTTGTATTGCATAGACGGTGCTTTACTTACAAAGTCCTCAGAAT |
| ACAAAGGTCCTATTACGGATGTTTTCTACAAAGAAAACAGTTACAACAACCATAAAACCAGTTACTTATAAATTGGATGGTGTTGTTT |
| GTACAGAAATTGACCCTAAGTTGGACAATTATTATAAGAAAGACAATTCTTATTTCACAGAGCAACCAATTGATCTTGTACCAAACCAAC |
| CATATCCAAACGCAAGCTTCGATAATTTTAAGTTTGTATGTGATAATATCAAATTTGCTGATGATTTAAACCAGTTAACTGGTTATAAGAA |
| ACCTGCTTCAAGAGAGCTTAAAGTTACATTTTTCCCTGACTTAAATGGTGATGTGGTGGCTATTGATTATAAACACTACACACCCTCTTTT |
| AAGAAAGGAGCTAAATTGTTACATAAACCTATTGTTTGGCATGTTAACAATGCAACTAATAAAGCCACGTATAAACCAAATACCTGGTGT |
| ATACGTTGTCTTTGGAGCACAAAACCAGTTGAAACATCAAATTCGTTTGATGTACTGAAGTCAGAGGACGCGCAGGGAATGGATAATCT |
| TGCCTGCGAAGATCTAAAACCAGTCTCTGAAGAAGTAGTGGAAAATCCTACCATACAGAAAGACGTTCTTGAGTGTAATGTGAAAACTA |
| CCGAAGTTGTAGGAGACATTATACTTAAACCAGCAAATAATAGTTTAAAAATTACAGAAGAGGTTGGCCACACAGATCTAATGGCTGCT |
| TATGTAGACAATTCTAGTCTTACTATTAAGAAACCTAATGAATTATCTAGAGTATTAGGTTTGAAAACCCTTGCTACTCATGGTTTAGCTG |
| CTGTTAATAGTGTCCCTTGGGATACTATAGCTAATTATGCTAAGCCTTTTCTTAACAAAGTTGTTAGTACAACTACTAACATAGTTACACG |
| GTGTTTAAACCGTGTTTGTACTAATTATATGCCTTATTTCTTTACTTTATTGCTACAATTGTGTACTTTTACTAGAAGTACAAATTCTAGAAT |
| TAAAGCATCTATGCCGACTACTATAGCAAAGAATACTGTTAAGAGTGTCGGTAAATTTTGTCTAGAGGCTTCATTTAATTATTTGAAGTCA |
| CCTAATTTTTCTAAACTGATAAATATTATAATTTGGTTTTTACTATTAAGTGTTTGCCTAGGTTCTTTAATCTACTCAACCGCTGCTTTAGGT |
| GTTTTAATGTCTAATTTAGGCATGCCTTCTTACTGTACTGGTTACAGAGAAGGCTATTTGAACTCTACTAATGTCACTATTGCAACCTACTG |
| TACTGGTTCTATACCTTGTAGTGTTTGTCTTAGTGGTTTAGATTCTTTAGACACCTATCCTTCTTTAGAAACTATACAAATTACCATTTCATC |
| TTTTAAATGGGATTTAACTGCTTTTGGCTTAGTTGCAGAGTGGTTTTTGGCATATATTCTTTTCACTAGGTTTTTCTATGTACTTGGATTGG |
| CTGCAATCATGCAATTGTTTTTCAGCTATTTTGCAGTACATTTTATTAGTAATTCTTGGCTTATGTGGTTAATAATTAATCTTGTACAAATG |
| GCCCCGATTTCAGCTATGGTTAGAATGTACATCTTCTTTGCATCATTTTATTATGTATGGAAAAGTTATGTGCATGTTGTAGACGGTTGTA |
| ATTCATCAACTTGTATGATGTGTTACAAACGTAATAGAGCAACAAGAGTCGAATGTACAACTATTGTTAATGGTGTTAGAAGGTCCTTTT |

-continued

| SEQUENCES |
|---|
| ATGTCTATGCTAATGGAGGTAAAGGCTTTTGCAAACTACACAATTGGAATTGTGTTAATTGTGATACATTCTGTGCTGGTAGTACATTTAT |
| TAGTGATGAAGTTGCGAGAGACTTGTCACTACAGTTTAAAAGACCAATAAATCCTACTGACCAGTCTTCTTACATCGTTGATAGTGTTAC |
| AGTGAAGAATGGTTCCATCCATCTTTACTTTGATAAAGCTGGTCAAAAGACTTATGAAAGACATTCTCTCTCATTTTGTTAACTTAGAC |
| AACCTGAGAGCTAATAACACTAAAGGTTCATTGCCTATTAATGTTATAGTTTTTGATGGTAAATCAAAATGTGAAGAATCATCTGCAAAA |
| TCAGCGTCTGTTTACTACAGTCAGCTTATGTGTCAACCTATACTGTTACTAGATCAGGCATTAGTGTCTGATGTTGGTGATAGTGCGGAA |
| GTTGCAGTTAAAATGTTTGATGCTTACGTTAATACGTTTTCATCAACTTTTAACGTACCAATGGAAAAACTCAAAACACTAGTTGCAACTG |
| CAGAAGCTGAACTTGCAAAGAATGTGTCCTTAGACAATGTCTTATCTACTTTTATTTCAGCAGCTCGGCAAGGGTTTGTTGATTCAGATGT |
| AGAAACTAAAGATGTTGTTGAATGTCTTAAATTGTCACATCAATCTGACATAGAAGTTACTGGCGATAGTTGTAATAACTATATGCTCAC |
| CTATAACAAAGTTGAAAACATGACACCCCGTGACCTTGGTGCTTGTATTGACTGTAGTGCGCGTCATATTAATGCGCAGGTAGCAAAAA |
| GTCACAACATTGCTTTGATATGGAACGTTAAAGATTTCATGTCATTGTCTGAACAACTACGAAAACAAATACGTAGTGCTGCTAAAAAGA |
| ATAACTTACCTTTTAAGTTGACATGTGCAACTACTAGACAAGTTGTTAATGTTGTAACAACAAAGATAGCACTTAAGGGTGGTAAAATTG |
| TTAATAATTGGTTGAAGCAGTTAATTAAAGTTACACTTGTGTTCCTTTTTGTTGCTGCTATTTTCTATTTAATAACACCTGTTCATGTCATGT |
| CTAAACATACTGACTTTTCAAGTGAAATCATAGGATACAAGGCTATTGATGGTGGTGTCACTCGTGACATAGCATCTACAGATACTTGTT |
| TTGCTAACAAACATGCTGATTTTGACACATGGTTTAGCCAGCGTGGTGGTAGTTATACTAATGACAAAGCTTGCCCATTGATTGCTGCAG |
| TCATAACAAGAGAAGTGGGTTTTGTCGTGCCTGGTTTGCCTGGCACGATATTACGCACAACTAATGGTGACTTTTTGCATTTCTTACCTAG |
| AGTTTTTAGTGCAGTTGGTAACATCTGTTACACACCATCAAAACTTATAGAGTACACTGACTTTGCAACATCAGCTTGTGTTTTGGCTGCT |
| GAATGTACAATTTTTAAAGATGCTTCTGGTAAGCCAGTACCATATTGTTATGATACCAATGTACTAGAAGGTTCTGTTGCTTATGAAAGTT |
| TACGCCCTGACACACGTTATGTGCTCATGGATGGCTCTATTATTCAATTTCCTAACACCTACCTTGAAGGTTCTGTTAGAGTGGTAACAAC |
| TTTTGATTCTGAGTACTGTAGGCACGGCACTTGTGAAAGATCAGAAGCTGGTGTTTGTGTATCTACTAGTGGTAGATGGGTACTTAACAA |
| TGATTATTACAGATCTTTACCAGGAGTTTTCTGTGGTGTAGATGCTGTAAATTTACTTACTAATATGTTTACACCACTAATTCAACCTATTG |
| GTGCTTTGGACATATCAGCATCTATAGTAGCTGGTGGTATTGTAGCTATCGTAGTAACATGCCTTGCCTACTATTTTATGAGGTTTAGAAG |
| AGCTTTTGGTGAATACAGTCATGTAGTTGCCTTTAATACTTTACTATTCCTTATGTCATTCACTGTACTCTGTTTAACACCAGTTTACTCATT |
| CTTACCTGGTGTTTATTCTGTTATTTACTTGTACTTGACATTTTATCTTACTAATGATGTTTCTTTTTTAGCACATATTCAGTGGATGGTTAT |
| GTTCACACCTTTAGTACCTTTCTGGATAACAATTGCTTATATCATTTGTATTTCCACAAAGCATTTCTATTGGTTCTTTAGTAATTACCTAAA |
| GAGACGTGTAGTCTTTAATGGTGTTTCCTTTAGTACTTTTGAAGAAGCTGCGCTGTGCACCTTTTTGTTAAATAAAGAAATGTATCTAAAG |
| TTGCGTAGTGATGTGCTATTACCTCTTACGCAATATAATAGATACTTAGCTCTTTATAATAAGTACAAGTATTTTAGTGGAGCAATGGATA |
| CAACTAGCTACAGAGAAGCTGCTTGTTGTCATCTCGCAAAGGCTCTCAATGACTTCAGTAACTCAGGTTCTGATGTTCTTTACCAACCACC |
| ACAAACCTCTATCACCTCAGCTGTTTTGCAGAGTGGTTTTAGAAAAATGGCATTCCCATCTGGTAAAGTTGAGGGTTGTATGGTACAAGT |
| AACTTGTGGTACAACTACACTTAACGGTCTTTGGCTTGATGACGTAGTTTACTGTCCAAGACATGTGATCTGCACCTCTGAAGACATGCTT |
| AACCCTAATTATGAAGATTACTCATTCGTAAGTCTAATCATAATTTCTTGGTACAGGCTGGTAATGTTCAACTCAGGGTTATTGGACATT |
| CTATGCAAAATTGTGTACTTAAGCTTAAGGTTGATACAGCCAATCCTAAGACACCTAAGTATAAGTTTGTTCGCATTCAACCAGGACAGA |
| CTTTTTCAGTGTTAGCTTGTTACAATGGTTCACCATCTGGTGTTTACCAATGTGCTATGAGGCCCAATTTCACTATTAAGGGTTCATTCCTT |
| AATGGTTCATGTGGTAGTGTTGGTTTTAACATAGATTATGACTGTGTCTCTTTTTGTTACATGCACCATATGGAATTACCAACTGGAGTTC |
| ATGCTGGCACAGACTTAGAAGGTAACTTTTATGGACCTTTTGTTGACAGGCAAACAGCACAAGCAGCTGGTACGGACACAACTATTACA |
| GTTAATGTTTTAGCTTGGTTGTACGCTGCTGTTATAAATGGAGACAGGTGGTTTCTCAATCGATTTACCACAACTCTTAATGACTTTAACC |
| TTGTGGCTATGAAGTACAATTATGAACCTCTAACACAAGACCATGTTGACATACTAGGACCTCTTTCTGCTCAAACTGGAATTGCCGTTTT |
| AGATATGTGTGCTTCATTAAAAGAATTACTGCAAAATGGTATGAATGGACGTACCATATTGGGTAGTGCTTTATTAGAAGATGAATTTAC |
| ACCTTTTGATGTTGTTAGACAATGCTCAGGTGTTACTTTCCAAAGTGCAGTGAAAAGAACAATCAAGGGTACACACCACTGGTTGTTACT |
| CACAATTTTGACTTCACTTTTAGTTTTAGTCCAGAGTACTCAATGGTCTTTGTTCTTTTTTTGTATGAAAATGCCTTTTTACCTTTTGCTATG |

-continued

SEQUENCES

```
GGTATTATTGCTATGTCTGCTTTTGCAATGATGTTTGTCAAACATAAGCATGCATTTCTCTGTTTGTTTTTGTTACCTTCTCTTGCCACTGTA
GCTTATTTTAATATGGTCTATATGCCTGCTAGTTGGGTGATGCGTATTATGACATGGTTGGATATGGTTGATACTAGTTTGTCTGGTTTTA
AGCTAAAAGACTGTGTTATGTATGCATCAGCTGTAGTGTTACTAATCCTTATGACAGCAAGAACTGTGTATGATGATGGTGCTAGGAGA
GTGTGGACACTTATGAATGTCTTGACACTCGTTTATAAAGTTTATTATGGTAATGCTTTAGATCAAGCCATTTCCATGTGGGCTCTTATAA
TCTCTGTTACTTCTAACTACTCAGGTGTAGTTACAACTGTCATGTTTTTGGCCAGAGGTATTGTTTTTATGTGTGTTGAGTATTGCCCTATT
TTCTTCATAACTGGTAATACACTTCAGTGTATAATGCTAGTTTATTGTTTCTTAGGCTATTTTTGTACTTGTTACTTTGGCCTCTTTTGTTTAC
TCAACCGCTACTTTAGACTGACTCTTGGTGTTTATGATTACTTAGTTTCTACACAGGAGTTTAGATATATGAATTCACAGGGACTACTCCC
ACCCAAGAATAGCATAGATGCCTTCAAACTCAACATTAAATTGTTGGGTGTTGGTGGCAAACCTTGTATCAAAGTAGCCACTGTACAGTC
TAAAATGTCAGATGTAAAGTGCACATCAGTAGTCTTACTCTCAGTTTTGCAACAACTCAGAGTAGAATCATCATCTAAATTGTGGGCTCA
ATGTGTCCAGTTACACAATGACATTCTCTTAGCTAAAGATACTACTGAAGCCTTTGAAAAAATGGTTTCACTACTTTCTGTTTTGCTTTCCA
TGCAGGGTGCTGTAGACATAAACAAGCTTTGTGAAGAAATGCTGGACAACAGGGCAACCTTACAAGCTATAGCCTCAGAGTTTAGTTCC
CTTCCATCATATGCAGCTTTTGCTACTGCTCAAGAAGCTTATGAGCAGGCTGTTGCTAATGGTGATTCTGAAGTTGTTCTTAAAAAGTTGA
AGAAGTCTTTGAATGTGGCTAAATCTGAATTTGACCGTGATGCAGCCATGCAACGTAAGTTGGAAAAGATGGCTGATCAAGCTATGACC
CAAATGTATAAACAGGCTAGATCTGAGGACAAGAGGGCAAAAGTTACTAGTGCTATGCAGACAATGCTTTTCACTATGCTTAGAAAGTT
GGATAATGATGCACTCAACAACATTATCAACAATGCAAGAGATGGTTGTGTTCCCTTGAACATAATACCTCTTACAACAGCAGCCAAACT
AATGGTTGTCATACCAGACTATAACACATATAAAAATACGTGTGATGGTACAACATTTACTTATGCATCAGCATTGTGGGAAATCCAACA
GGTTGTAGATGCAGATAGTAAAATTGTTCAACTTAGTGAAATTAGTATGGACAATTCACCTAATTTAGCATGGCCTCTTATTGTAACAGC
TTTAAGGGCCAATTCTGCTGTCAAATTACAGAATAATGAGCTTAGTCCTGTTGCACTACGACAGATGTCTTGTGCTGCCGGTACTACACA
AACTGCTTGCACTGATGACAATGCGTTAGCTTACTACAACACAACAAAGGGAGGTAGGTTTGTACTTGCACTGTTATCCGATTTACAGGA
TTTGAAATGGGCTAGATTCCCTAAGAGTGATGGAACTGGTACTATCTATACAGAACTGGAACCACCTTGTAGGTTTGTTACAGACACACC
TAAAGGTCCTAAAGTGAAGTATTTATACTTTATTAAAGGATTAAACAACCTAAATAGAGGTATGGTACTTGGTAGTTTAGCTGCCACAGT
ACGTCTACAAGCTGGTAATGCAACAGAAGTGCCTGCCAATTCAACTGTATTATCTTTCTGTGCTTTTGCTGTAGATGCTGCTAAAGCTTAC
AAAGATTATCTAGCTAGTGGGGACAACCAATCACTAATTGTGTTAAGATGTTGTGTACACACACTGGTACTGGTCAGGCAATAACAGT
TACACCGGAAGCCAATATGGATCAAGAATCCTTTGGTGGTGCATCGTGTTGTCTGTACTGCCGTTGCCACATAGATCATCCAAATCCTAA
AGGATTTTGTGACTTAAAAGGTAAGTATGTACAAATACCTACAACTTGTGCTAATGACCCTGTGGGTTTACACTTAAAAACACAGTCTG
TACCGTCTGCGGTATGTGGAAAGGTTATGGCTGTAGTTGTGATCAACTCCGCGAACCCATGCTTCAGTCAGCTGATGCACAATCGTTTTT
AAACGGGTTTGCGGTGTAAGTGCAGCCCGTCTTACACCGTGCGGCACAGGCACTAGTACTGATGTCGTATACAGGGCTTTTGACATCTA
CAATGATAAAGTAGCTGGTTTTGCTAAATTCCTAAAAACTAATTGTTGTCGCTTCCAAGAAAAGGACGAAGATGACAATTTAATTGATTC
TTACTTTGTAGTTAAGAGACACACTTTCTCTAACTACCAACATGAAGAAACAATTTATAATTTACTTAAGGATTGTCCAGCTGTTGCTAAA
CATGACTTCTTTAAGTTTAGAATAGACGGTGACATGGTACCACATATATCACGTCAACGTCTTACTAAATACACAATGGCAGACCTCGTCT
ATGCTTTAAGGCATTTTGATGAAGGTAATTGTGACACATTAAAAGAAATACTTGTCACATACAATTGTTGTGATGATGATTATTTCAATAA
AAAGGACTGGTATGATTTTGTAGAAAACCCAGATATATTACGCGTATACGCCAACTTAGGTGAACGTGTACGCCAAGCTTTGTTAAAAAC
AGTACAATTCTGTGATGCCATGCGAAATGCTGGTATTGTTGGTGTACTGACATTAGATAATCAAGATCTCAATGGTAACTGGTATGATTT
CGGTGATTTCATACAAACCACGCCAGGTAGTGGAGTTCCTGTTGTAGATTCTTATTATTCATTGTTAATGCCTATATTAACCTTGACCAGG
GCTTTAACTGCAGAGTCACATGTTGACACTGACTTAACAAAGCCTTACATTAAGTGGGATTTGTTAAAATATGACTTCACGGAAGAGAGG
TTAAAACTCTTTGACCGTTATTTTAAATATTGGGATCAGACATACCACCCAAATTGTGTTAACTGTTTGGATGACAGATGCATTCTGCATT
GTGCAAACTTTAATGTTTTATTCTCTACAGTGTTCCCACTTACAAGTTTGGACCACTAGTGAGAAAATATTTGTTGATGGTGTTCCATTT
GTAGTTTCAACTGGATACCACTTCAGAGAGCTAGGTGTTGTACATAATCAGGATGTAAACTTACATAGCTCTAGACTTAGTTTTAAGGAA
```

| SEQUENCES |
|---|
| TTACTTGTGTATGCTGCTGACCCTGCTATGCACGCTGCTTCTGGTAATCTATTACTAGATAAACGCACTACGTGCTTTTCAGTAGCTGCAC |
| TTACTAACAATGTTGCTTTTCAAACTGTCAAACCCGGTAATTTTAACAAAGACTTCTATGACTTTGCTGTGTCTAAGGGTTTCTTTAAGGA |
| AGGAAGTTCTGTTGAATTAAAACACTTCTTCTTTGCTCAGGATGGTAATGCTGCTATCAGCGATTATGACTACTATCGTTATAATCTACCA |
| ACAATGTGTGATATCAGACAACTACTATTTGTAGTTGAAGTTGTTGATAAGTACTTTGATTGTTACGATGGTGGCTGTATTAATGCTAACC |
| AAGTCATCGTCAACAACCTAGACAAATCAGCTGGTTTTCCATTTAATAAATGGGGTAAGGCTAGACTTTATTATGATTCAATGAGTTATG |
| AGGATCAAGATGCACTTTTCGCATATACAAAACGTAATGTCATCCCTACTATAACTCAAATGAATCTTAAGTATGCCATTAGTGCAAAGA |
| ATAGAGCTCGCACCGTAGCTGGTGTCTCTATCTGTAGTACTATGACCAATAGACAGTTTCATCAAAAATTATTGAAATCAATAGCCGCCA |
| CTAGAGGAGCTACTGTAGTAATTGGAACAAGCAAATTCTATGGTGGTTGGCACAACATGTTAAAAACTGTTTATAGTGATGTAGAAAAC |
| CCTCACCTTATGGGTTGGGATTATCCTAAATGTGATAGAGCCATGCCTAACATGCTTAGAATTATGGCCTCACTTGTTCTTGCTCGCAAAC |
| ATACAACGTGTTGTAGCTTGTCACACCGTTTCTATAGATTAGCTAATGAGTGTGCTCAAGTATTGAGTGAAATGGTCATGTGTGGCGGTT |
| CACTATATGTTAAACCAGGTGGAACCTCATCAGGAGATGCCACAACTGCTTATGCTAATAGTGTTTTTAACATTTGTCAAGCTGTCACGG |
| CCAATGTTAATGCACTTTTATCTACTGATGGTAACAAAATTGCCGATAAGTATGTCCGCAATTTACAACACAGACTTTATGAGTGTCTCTA |
| TAGAAATAGAGATGTTGACACAGACTTTGTGAATGAGTTTTACGCATATTTGCGTAAACATTTCTCAATGATGATACTCTCTGACGATGCT |
| GTTGTGTGTTTCAATAGCACTTATGCATCTCAAGGTCTAGTGGCTAGCATAAAGAACTTTAAGTCAGTTCTTTATTATCAAAACAATGTTT |
| TTATGTCTGAAGCAAAATGTTGGACTGAGACTGACCTTACTAAAGGACCTCATGAATTTTGCTCTCAACATACAATGCTAGTTAAACAGG |
| GTGATGATTATGTGTACCTTCCTTACCCAGATCCATCAAGAATCCTAGGGGCCGGCTGTTTTGTAGATGATATCGTAAAACAGATGGTA |
| CACTTATGATTGAACGGTTCGTGTCTTTAGCTATAGATGCTTACCCACTTACTAAACATCCTAATCAGGAGTATGCTGATGTCTTTCATTTG |
| TACTTACAATACATAAGAAAGCTACATGATGAGTTAACAGGACACATGTTAGACATGTATTCTGTTATGCTTACTAATGATAACACTTCAA |
| GGTATTGGGAACCTGAGTTTTATGAGGCTATGTACACACCGCATACAGTCTTACAGGCTGTTGGGGCTTGTGTTCTTTGCAATTCACAGA |
| CTTCATTAAGATGTGGTGCTTGCATACGTAGACCATTCTTATGTTGTAAATGCTGTTACGACCATGTCATATCAACATCACATAAATTAGT |
| CTTGTCTGTTAATCCGTATGTTTGCAATGCTCCAGGTTGTGATGTCACAGATGTGACTCAACTTTACTTAGGAGGTATGAGCTATTATTGT |
| AAATCACATAAACCACCCATTAGTTTTCCATTGTGTGCTAATGGACAAGTTTTTGGTTTATATAAAAATACATGTGTTGGTAGCGATAATG |
| TTACTGACTTTAATGCAATTGCAACATGTGACTGGACAAATGCTGGTGATTACATTTTAGCTAACACCTGTACTGAAAGACTCAAGCTTTT |
| TGCAGCAGAAACGCTCAAAGCTACTGAGGAGACATTTAAACTGTCTTATGGTATTGCTACTGTACGTGAAGTGCTGTCTGACAGAGAAT |
| TACATCTTTCATGGGAAGTTGGTAAACCTAGACCACCACTTAACCGAAATTATGTCTTTACTGGTTATCGTGTAACTAAAAACAGTAAAGT |
| ACAAATAGGAGAGTACACCTTTGAAAAAGGTGACTATGGTGATGCTGTTGTTTACCGAGGTACAACAACTTACAAATTAAATGTTGGTG |
| ATTATTTTGTGCTGACATCACATACAGTAATGCCATTAAGTGCACCTACACTAGTGCCACAAGAGCACTATGTTAGAATTACTGGCTTATA |
| CCCAACACTCAATATCTCAGATGAGTTTTCTAGCAATGTTGCAAATTATCAAAAGGTTGGTATGCAAAGTATTCTACACTCCAGGGACC |
| ACCTGGTACTGGTAAGAGTCATTTTGCTATTGGCCTAGCTCTCTACTACCCTTCTGCTCGCATAGTGTATACAGCTTGCTCTCATGCCGCT |
| GTTGATGCACTATGTGAGAAGGCATTAAAATATTTGCCTATAGATAAATGTAGTAGAATTATACCTGCACGTGCTCGTGTAGAGTGTTTT |
| GATAAATTCAAAGTGAATTCAACATTAGAACAGTATGTCTTTTGTACTGTAAATGCATTGCCTGAGACGACAGCAGATATAGTTGTCTTT |
| GATGAAATTTCAATGGCCACAAATTATGATTTGAGTGTTGTCAATGCCAGATTACGTGCTAAGCACTATGTGTACATTGGCGACCCTGCT |
| CAATTACCTGCACCACGCACATTGCTAACTAAGGGCACACTAGAACCAGAATATTTCAATTCAGTGTGTAGACTTATGAAAACTATAGGT |
| CCAGACATGTTCCTCGGAACTTGTCGGCGTTGTCCTGCTGAAATTGTTGACACTGTGAGTGCTTTGGTTTATGATAATAAGCTTAAAGCA |
| CATAAAGACAAATCAGCTCAATGCTTTAAAATGTTTTATAAGGGTGTTATCACGCATGATGTTTCATCTGCAATTAACAGGCCACAAATA |
| GGCGTGGTAAGAGAATTCCTTACACGTAACCCTGCTTGGAGAAAAGCTGTCTTTATTTCACCTTATAATTCACAGAATGCTGTAGCCTCA |
| AAGATTTTGGGACTACCAACTCAAACTGTTGATTCATCACAGGGCTCAGAATATGACTATGTCATATTCACTCAAACCACTGAAACAGCT |
| CACTCTTGTAATGTAAACAGATTTAATGTTGCTATTACCAGAGCAAAAGTAGGCATACTTTGCATAATGTCTGATAGAGACCTTTATGACA |
| AGTTGCAATTTACAAGTCTTGAAATTCCACGTAGGAATGTGGCAACTTTACAAGCTGAAAATGTAACAGGACTCTTTAAAGATTGTAGTA |

-continued

| SEQUENCES |
| --- |
| AGGTAATCACTGGGTTACATCCTACACAGGCACCTACACACCTCAGTGTTGACACTAAATTCAAAACTGAAGGTTTATGTGTTGACATAC |
| CTGGCATACCTAAGGACATGACCTATAGAAGACTCATCTCTATGATGGGTTTTAAAATGAATTATCAAGTTAATGGTTACCCTAACATGTT |
| TATCACCCGCGAAGAAGCTATAAGACATGTACGTGCATGGATTGGCTTCGATGTCGAGGGGTGTCATGCTACTAGAGAAGCTGTTGGTA |
| CCAATTTACCTTTACAGCTAGGTTTTTCTACAGGTGTTAACCTAGTTGCTGTACCTACAGGTTATGTTGATACACCTAATAATACAGATTTT |
| TCCAGAGTTAGTGCTAAACCACCGCCTGGAGATCAATTTAAACACCTCATACCACTTATGTACAAAGGACTTCCTTGGAATGTAGTGCGT |
| ATAAAGATTGTACAAATGTTAAGTGACACACTTAAAAATCTCTCTGACAGAGTCGTATTTGTCTTATGGGCACATGGCTTTGAGTTGACA |
| TCTATGAAGTATTTTGTGAAAATAGGACCTGAGCGCACCTGTTGTCTATGTGATAGACGTGCCACATGCTTTTCCACTGCTTCAGACACTT |
| ATGCCTGTTGGCATCATTCTATTGGATTTGATTACGTCTATAATCCGTTTATGATTGATGTTCAACAATGGGGTTTTACAGGTAACCTACA |
| AAGCAACCATGATCTGTATTGTCAAGTCCATGGTAATGCACATGTAGCTAGTTGTGATGCAATCATGACTAGGTGTCTAGCTGTCCACGA |
| GTGCTTTGTTAAGCGTGTTGACTGGACTATTGAATATCCTATAATTGGTGATGAACTGAAGATTAATGCGGCTTGTAGAAAGGTTCAACA |
| CATGGTTGTTAAAGCTGCATTATTAGCAGACAAATTCCCAGTTCTTCACGACATTGGTAACCCTAAAGCTATTAAGTGTGTACCTCAAGCT |
| GATGTAGAATGGAAGTTCTATGATGCACAGCCTTGTAGTGACAAAGCTTATAAAATAGAAGAATTATTCTATTCTTATGCCACACATTCT |
| GACAAATTCACAGATGGTGTATGCCTATTTTGGAATTGCAATGTCGATAGATATCCTGCTAATTCCATTGTTTGTAGATTTGACACTAGAG |
| TGCTATCTAACCTTAACTTGCCTGGTTGTGATGGTGGCAGTTTGTATGTAAATAAACATGCATTCCACACACCAGCTTTTGATAAAAGTGC |
| TTTTGTTAATTTAAAACAATTACCATTTTTCTATTACTCTGACAGTCCATGTGAGTCTCATGGAAAACAAGTAGTGTCAGATATAGATTAT |
| GTACCACTAAAGTCTGCTACGTGTATAACACGTTGCAATTTAGGTGGTGCTGTCTGTAGACATCATGCTAATGAGTACAGATTGTATCTC |
| GATGCTTATAACATGATGATCTCAGCTGGCTTTAGCTTGTGGGTTTACAAACAATTTGATACTTATAACCTCTGGAACACTTTTACAAGAC |
| TTCAGAGTTTAGAAAATGTGGCTTTTAATGTTGTAAATAAGGGACACTTTGATGGACAACAGGGTGAAGTACCAGTTTCTATCATTAATA |
| ACACTGTTTACACAAAAGTTGATGGTGTTGATGTAGAATTGTTTGAAAATAAAACAACATTACCTGTTAATGTAGCATTTGAGCTTTGGG |
| CTAAGCGCAACATTAAACCAGTACCAGAGGTGAAAATACTCAATAATTTGGGTGTGGACATTGCTGCTAATACTGTGATCTGGGACTAC |
| AAAAGAGATGCTCCAGCACATATATCTACTATTGGTGTTTGTTCTATGACTGACATAGCCAAGAAACCAACTGAAACGATTTGTGCACCA |
| CTCACTGTCTTTTTTGATGGTAGAGTTGATGGTCAAGTAGACTTATTTAGAAATGCCCGTAATGGTGTTCTTATTACAGAAGGTAGTGTTA |
| AAGGTTTACAACCATCTGTAGGTCCCAAACAAGCTAGTCTTAATGGAGTCACATTAATTGGAGAAGCCGTAAAAACACAGTTCAATTATT |
| ATAAGAAAGTTGATGGTGTTGTCCAACAATTACCTGAAACTTACTTTACTCAGAGTAGAAATTTACAAGAATTTAAACCCAGGAGTCAAA |
| TGGAAATTGATTTCTTAGAATTAGCTATGGATGAATTCATTGAACGGTATAAATTAGAAGGCTATGCCTTCGAACATATCGTTTATGGAG |
| ATTTTAGTCATAGTCAGTTAGGTGGTTTACATCTACTGATTGGACTAGCTAAACGTTTTAAGGAATCACCTTTTGAATTAGAAGATTTTAT |
| TCCTATGGACAGTACAGTTAAAAACTATTTCATAACAGATGCGCAAACAGGTTCATCTAAGTGTGTGTGTTCTGTTATTGATTTATTACTT |
| GATGATTTTGTTGAAATAATAAAATCCCAAGATTTATCTGTAGTTTCTAAGGTTGTCAAAGTGACTATTGACTATACAGAAATTTCATTTA |
| TGCTTTGGTGTAAAGATGGCCATGTAGAAACATTTTACCCAAAATTACAATCTAGTCAAGCGTGGCAACCGGGTGTTGCTATGCCTAATC |
| TTTACAAAATGCAAAGAATGCTATTAGAAAAGTGTGACCTTCAAAATTATGGTGATAGTGCAACATTACCTAAAGGCATAATGATGAAT |
| GTCGCAAAATATACTCAACTGTGTCAATATTTAAACACATTAACATTAGCTGTACCCTATAATATGAGAGTTATACATTTTGGTGCTGGTT |
| CTGATAAAGGAGTTGCACCAGGTACAGCTGTTTTAAGACAGTGGTTGCCTACGGGTACGCTGCTTGTCGATTCAGATCTTAATGACTTTG |
| TCTCTGATGCAGATTCAACTTTGATTGGTGATTGTGCAACTGTACATACAGCTAATAAATGGGATCTCATTATTAGTGATATGTACGACCC |
| TAAGACTAAAAATGTTACAAAAGAAAATGACTCTAAAGAGGGTTTTTTCACTTACATTTGTGGGTTTATACAACAAAAGCTAGCTCTTGG |
| AGGTTCCGTGGCTATAAAGATAACAGAACATTCTTGGAATGCTGATCTTTATAAGCTCATGGGACACTTCGCATGGTGGACAGCCTTTGT |
| TACTAATGTGAATGCGTCATCATCTGAAGCATTTTTAATTGGATGTAATTATCTTGGCAAACCACGCGAACAAATAGATGGTTATGTCAT |
| GCATGCAAATTACATATTTGGAGGAATACAAATCCAATTCAGTTGTCTTCCTATTCTTTATTTGACATGAGTAAATTTCCCCTTAAATTAA |
| GGGGTACTGCTGTTATGTCTTTAAAAGAAGGTCAAATCAATGATATGATTTTATCTCTTCTTAGTAAAGGTAGACTTATAATTAGAGAAA |

| SEQUENCES |
|---|
| ACAACAGAGTTGTTATTTCTAGTGATGTTCTTGTTAACAACTAAACGAACAATGTTTGTTTTTCTTGTTTTATTGCCACTAGTCTCTAGTCA |
| GTGTGTTAATCTTACAACCAGAACTCAATTACCCCCTGCATACACTAATTCTTTCACACGTGGTGTTTATTACCCTGACAAAGTTTTCAGAT |
| CCTCAGTTTTACATTCAACTCAGGACTTGTTCTTACCTTTCTTTTCCAATGTTACTTGGTTCCATGCTATACATGTCTCTGGGACCAATGGTA |
| CTAAGAGGTTTGATAACCCTGTCCTACCATTTAATGATGGTGTTTATTTTGCTTCCACTGAGAAGTCTAACATAATAAGAGGCTGGATTTT |
| TGGTACTACTTTAGATTCGAAGACCCAGTCCCTACTTATTGTTAATAACGCTACTAATGTTGTTATTAAAGTCTGTGAATTTCAATTTTGTA |
| ATGATCCATTTTGGGTGTTTATTACCACAAAAACAACAAAAGTTGGATGGAAAGTGAGTTCAGAGTTTATTCTAGTGCGAATAATTGCA |
| CTTTTGAATATGTCTCTCAGCCTTTTCTTATGGACCTTGAAGGAAAACAGGGTAATTTCAAAAATCTTAGGGAATTTGTGTTTAAGAATAT |
| TGATGGTTATTTTAAAATATATTCTAAGCACACGCCTATTAATTTAGTGCGTGATCTCCCTCAGGGTTTTTCGGCTTTAGAACCATTGGTA |
| GATTTGCCAATAGGTATTAACATCACTAGGTTTCAAACTTTACTTGCTTTACATAGAAGTTATTTGACTCCTGGTGATTCTTCTTCAGGTTG |
| GACAGCTGGTGCTGCAGCTTATTATGTGGGTTATCTTCAACCTAGGACTTTTCTATTAAAATATAATGAAAATGGAACCATTACAGATGC |
| TGTAGACTGTGCACTTGACCCTCTCTCAGAAACAAAGTGTACGTTGAAATCCTTCACTGTAGAAAAAGGAATCTATCAAACTTCTAACTTT |
| AGAGKCCAACCAACAGAATCTATTGTTAGATTTCCTAATATTACAAACTTGTGCCCTTTTGGTGAAGTTTTTAACGCCACCAGATTTGCAT |
| CTGTTTATGCTTGGAACAGGAAGAGAATCAGCAACTGTGTTGCTGATTATTCTGTCCTATATAATTCCGCATCATTTTCCACTTTTAAGTGT |
| TATGGAGTGTCTCCTACTAAATTAAATGATCTCTGCTTTACTAATGTCTATGCAGATTCATTTGTAATTAGAGGTGATGAAGTCAGACAAA |
| TCGCTCCAGGGCAAACTGGAAAGATTGCTGATTATAATTATAAATTACCAGATGATTTTACAGGCTGCGTTATAGCTTGGAATTCTAACA |
| ATCTTGATTCTAAGGTTGGTGGTAATTATAATTACCTGTATAGATTGTTTAGGAAGTCTAATCTCAAACCTTTTGAGAGAGATATTTCAAC |
| TGAAATCTATCAGGCCGGTAGCACACCTTGTAATGGTGTTGAAGGTTTTAATTGTTACTTTCCTTTACAATCATATGGTTTCCAACCCACT |
| AATGGTGTTGGTTACCAACCATACAGAGTAGTAGTACTTTCTTTTGAACTTCTACATGCACCAGCAACTGTTTGTGGACCTAAAAAGTCTA |
| CTAATTTGGTTAAAAACAAATGTGTCAATTTCAACTTCAATGGTTTAACAGGCACAGGTGTTCTTACTGAGTCTAACAAAAAGTTTCTGCC |
| TTTCCAACAATTTGGCAGAGACATTGCTGACACTACTGATGCTGTCCGTGATCCACAGACACTTGAGATTCTTGACATTACACCATGTTCT |
| TTTGGTGGTGTCAGTGTTATAACACCAGGAACAAATACTTCTAACCAGGTTGCTGTTCTTTATCAGGGTGTTAACTGCACAGAAGTCCCT |
| GTTGCTATTCATGCAGATCAACTTACTCCTACTTGGCGTGTTTATTCTACAGGTTCTAATGTTTTTCAAACACGTGCAGGCTGTTTAATAGG |
| GGCTGAACATGTCAACAACTCATATGAGTGTGACATACCCATTGGTGCAGGTATATGCGCTAGTTATCAGACTCAGACTAATTCTCCTCG |
| GCGGGCACGTAGTGTAGCTAGTCAATCCATCATTGCCTACACTATGTCACTTGGTGCAGAAAATTCAGTTGCTTACTCTRATAACTCTATT |
| GCCATACCCACAAATTTTACTATTAGTGTTACCACAGAAATTCTACCAGTGTCTATGACCAAGACATCAGTAGATTGTACAATGTACATTT |
| GTGGTGATTCAACTGAATGCAGCAATCTTTTGTTGCAATATGGCAGTTTTTGTACACAATTAAACCGTGCTTTAACTGGAATAGCTGTTGA |
| ACAAGACAAAAACACCCAAGAAGTTTTTGCACAAGTCAAACAAATTTACAAAACACCACCAATTAAAGATTTTGGTGGTTTTAATTTTTCA |
| CAAATATTACCAGATCCATCAAAACCAAGCAAGAGGTCATTTATTGAAGATCTACTTTTCAACAAAGTGACACTTGCAGATGCTGGCTTC |
| ATCAAACAATATGGTGATTGCCTTGGTGATATTGCTGCTAGAGACCTCATTTGTGCACAAAAGTTTAACGGCCTTACTGTTTTGCCACCTT |
| TGCTCACAGATGAAATGATTGCTAATACACTTCTGCACTGTTAGCGGGTACAATACTTCTGGTTGGACCTTTGGTGCAGGTGCTGCAT |
| TACAAATACCATTTGCTATGCAAATGGCTTATAGGTTTAATGGTATTGGAGTTACACAGAATGTTCTCTATGAGAACCAAAAATTGATTG |
| CCAACCAATTTAATAGTGCTATTGGCAAAATTCAAGACTCACTTTCTTCCACAGCAAGTGCACTTGGAAAACTTCAAGATGTGGTCAACC |
| AAAATGCACAAGCTTTAAACACGCTTGTTAAACAACTTAGCTCCAATTTTGGTGCAATTTCAAGTGTTTTAAATGATATCCTTTCACGTCTT |
| GACAAAGTTGAGGCTGAAGTGCAAATTGATAGGTTGATCACAGGCAGACTTCAAAGTTTGCAGACATATGTGACTCAACAATTAATTAG |
| AGCTGCAGAAATCAGAGTTTCTGCTAATCTTGCTGCTACTAAAATGTCAGAGTGTGTACTTGGACAATCAAAAAGAGTTGATTTTTGTGG |
| AAAGGGCTATCATCTTATGTCCTTCCCTCAGTCAGCACCTCATGGTGTAGTCTTCTTGCATGTGACTTATGTCCCTGCACAAGAAAAGAAC |
| TTCACAACTGCTCCTGCCATTTGTCATGATGGAAAAGCACACTTTCCTCGTGAAGGTGTCTTTGTTTCAAATGGCACACACTGGTTTGTAA |
| CACAAAGGAATTTTTATGAACCACAAATCATTACTACAGACAACACATTTGTGTCTGGTAACTGTGATGTTGTAATAGGAATTGTCAACA |
| ACACAGTTTATGATCCTTTGCAACCTGAATTAGACTCATTCAAGGAGGAGTTAGATAAATATTTTAAGAATCATACATCACCAGATGTTG |

| SEQUENCES |
|---|
| ATTTAGGTGACATCTCTGGCATTAATGCTTCAGTTGTAAACATTCAAAAAGAAATTGACCGCCTCAATGAGGTTGCCAAGAATTTAAATG |
| AATCTCTCATCGATCTCCAAGAACTTGGAAAGTATGAGCAGTATATAAAATGGCCATGGTACATTTGGCTAGGTTTTATAGCTGGCTTGA |
| TTGCCATAGTAATGGTGACAATTATGCTTTGCTGTATGACCAGTTGCTGTAGTTGTCTCAAGGGCTGTTGTTCTTGTGGATCCTGCTGCAA |
| ATTTGATGAAGACGACTCTGAGCCAGTGCTCAAAGGAGTCAAATTACATTACACATAAACGAACTTATGGATTTGTTTATGAGAATCTTC |
| ACAATTGGAACTGTAACTTTGAAGCAAGGTGAAATCAAGGATGCTACTCCTTCAGATTTTGTTCGCGCTACTGCAACGATACCGATACAA |
| GCCTCACTCCCTTTCGGATGGCTTATTGTTGGCGTTGCACTTCTTGCTGTTTTTCAGAGCGCTTCCAAAATCATAACCCTCAAAAGAGAT |
| GGCAACTAGCACTCTCCAAGGGTGTTCACTTTGTTTGCAACTTGCTGTTGTTGTTTGTAACAGTTTACTCACACCTTTTGCTCGTTGCTGCT |
| GGCCTTGAAGCCCCTTTTCTCTATCTTTATGCTTTAGTCTACTTCTTGCAGAGTATAAACTTTGTAAGAATAATAATGAGGCTTTGGCTTTG |
| CTGGAAATGCCGTTCCAAAAACCCATTACTTTATGATGCCAACTATTTTCTTTGCTGGCATACTAATTGTTACGACTATTGTATACCTTACA |
| ATAGTGTAACTTCTTCAATTGTCATTACTTCAGGTGATGGCACAACAAGTCCTATTTCTGAACATGACTACCAGATTGGTGGTTATACTGA |
| AAAATGGGAATCTGGAGTAAAAGACTGTGTTGTATTACACAGTTACTTCACTTCAGACTATTACCAGCTGTACTCAACTCAATTGAGTAC |
| AGACACTGGTGTTGAACATGTTACCTTCTTCATCTACAATAAAATTGTTGATGAGCCTGAAGAACATGTCCAAATTCACACAATCGACGG |
| TTCATCCGGAGTTGTTAATCCAGTAATGGAACCAATTTATGATGAACCGACGACGACTACTAGCGTGCCTTTGTAAGCACAAGCTGATGA |
| GTACGAACTTATGTACTCATTCGTTTCGGAAGAGMCAGGTACGTTAATAGTTAATAGCGTACTTCTTTTTCTTGCTTTCGTGGTATTCTTG |
| CTAGTTACACTAGCCATCCTTACTGCGCTTCGATTGTGTGCGTACTGCTGCAATATTGTTAACGTGAGTCTTGTAAAACCTTCTTTTTACGT |
| TTACTCTCGTGTTAAAAATCTGAATTCTTCTAGAGTTCCTGATCTTCTGGTCTAAACGAACTAAATATTATATTAGTTTTTCTGTTTGGAACT |
| TTAATTTTAGCCATGGCAGATTCCAACGGTACATTACCGTTGAAGAGCTTAAAAAGCTCCTTGAACAATGGAACCTAGTAATAGGTTTC |
| CTATTCCTTACATGGATTTGTCTTCTACAATTTGCCTATGCCAACAGGAATAGGTTTTTGTATATAATTAAGTTAATTTTCCTCTGGCTGTT |
| ATGGCCAGTAACTTTAGCTTGTTTTGTGCTTGCTGCTGTTTACAGAATAAATTGGATCACCGGTGGAATTGCTATCGCAATGGCTTGTCTT |
| GTAGGCTTGATGTGGCTCAGCTACTTCATTGCTTCTTTCAGACTGTTTGCGCGTACGCGTTCCATGTGGTCATTCAATCCAGAAACTAACA |
| TTCTTCTCAACGTGCCACTCCATGGCACTATTCTGACCAGACCGCTTCTAGAAAGTGAACTCGTAATCGGAGCTGTGATCCTTCGTGGAC |
| ATCTTCGTATTGCTGGACACCATCTAGGACGCTGTGACATCAAGGACCTGCCTAAAGAAATCACTGTTGCTACATCACGAATGCTTTCTTA |
| TTACAAATTGGGAGCTTCGCAGCGTGTAGCAGGTGACTCAGGTTTTGCTGCATACAGTCGCTACAGGATTGGCAACTATAAATTAAACA |
| CAGACCATTCCAGTAGCAGTGACAATATTGCTTTGCTTGTACAGTAAGTGACAACAGATGTTTCATCTCGTTGACTTTCAGGTTACTATAG |
| CAGAGATATTACTAATTATTATGAGGACTTTTAAAGTTTCCATTTGGAATCTTGATTACATCATAAACCTCATAATTAAAAATTTATCTAAG |
| TCACTAACTGAGAATAAATATTCTCAATTAGATGAAGAGCAACCAATGGAGATTGATTAAACGAACATGAAAATTATTCTTTTCTTGGCA |
| CTGATAACACTCGCTACTTGTGAGCTTTATCACTACCAAGAGTGTGTTAGAGGTACAACAGTACTTTTAAAAGAACCTTGCTCTTCTGGAA |
| CATACGAGGGCAATTCACCATTTCATCCTCTAGCTGATAACAAATTTGCACTGACTTGCTTTAGCACTCAATTTGCTTTTGCTTGTCCTGAC |
| GGCGTAAAACACGTCTATCAGTTACGTGCCAGATCAGTTTCACCTAAACTGTTCATCAGACAAGAGGAAGTTCAAGAACTTTACTCTCCA |
| ATTTTTCTTATTGTTGCGGCAATAGTGTTTATAACACTTTGCTTCACACTCAAAGAAAGACAGAATGATTGAACTTTCATTAATTGACTTC |
| TATTTGTGCTTTTTAGCCTTTCTGCTATTCCTTGTTTTAATTATGCTTATTATCTTTTGGTTCTCACTTGAACTGCAAGATCATAATGAAACTT |
| GTCACGCCTAAACGAACATGAAATTTCTTGTTTTCTTAGGAATCATCACAACTGTAGCTGCATTTCACCAAGAATGTAGTTTACAGTCATG |
| TACTCAACATCAACCATATGTAGTTGATGACCCGTGTCCTATTCACTTCTATTCTAAATGGTATATTAGAGTAGGAGCTAGAAAATCAGCA |
| CCTTTAATTGAATTGTGCGTGGATGAGGCTGGTTCTAAATCACCCATTCAGTACATCGATATCGGTAATTATACAGTTTCCTGTTTACCTTT |
| TACAATTAATTGCCAGGAACCTAAATTGGGTAGTCTTGTAGTGCGTTGTTCGTTCTATGAAGACTTTTTAGAGTATCATGACGTTCGTGTT |
| GTTTTAGATTTCATCTAAACGAACAAACTAAAATGTCTGATAATGGACCCCAAAATCAGCGAAATGCACCCCGCATTACGTTTGGTGGAC |
| CCTCAGATTCAACTGGCAGTAACCAGAATGGAGAACGCAGTGGGCGCGATCAAAACAACGTCGGCCCCAAGGTTTACCCAATAATACT |
| GCGTCTTGGTTCACCGCTCTCACTCAACATGGCAAGGAAGACCTTAAATTCCCTCGAGGACAAGGCGTTCCAATTAACACCAATAGCAGT |

| SEQUENCES |
|---|
| CCAGATGACCAAATTGGCTACTACCGAAGAGCTACCAGACGAATTCGTGGTGGTGACGGTAAAATGAAAGATCTCAGTCCAAGATGGT |
| ATTTCTACTACCTAGGAACTGGGCCAGAAGCTGGACTTCCCTATGGTGCTAACAAAGACGGCATCATATGGGTTGCAACTGAGGGAGCC |
| TTGAATACACCAAAAGATCACATTGGCACCCGCAATCCTGCTAACAATGCTGCAATCGTGCTACAACTTCCTCAAGGAACAACATTGCCA |
| AAAGGCTTCTACGCAGAAGGGAGCAGAGGCGGCAGTCAAGCCTCTTCTCGTTCCTCATCACGTAGTCGCAACAGTTCAAGAAATTCAAC |
| TCCAGGCAGCAGTAAACGAACTTCTCCTGCTAGAATGGCTGGCAATGGCGGTGATGCTGCTCTTGCTTTGCTGCTGCTTGACAGATTGAA |
| CCAGCTTGAGAGCAAAATGTCTGGTAAAGGCCAACAACAACAAGGCCAAACTGTCACTAAGAAATCTGCTGCTGAGGCTTCTAAGAAGC |
| CTCGGCAAAACGTACTGCCACTAAAGCATACAATGTAACACAAGCTTTCGGCAGACGTGGTCCAGAACAAACCCAAGGAAATTTTGGG |
| GACCAGGAACTAATCAGACAAGGAACTGATTACAAACATTGGCCGCAAATTGCACAATTTGCCCCCAGCGCTTCAGCGTTCTTCGGAAT |
| GTCGCGCATTGGCATGGAAGTCACACCTTCGGGAACGTGGTTGACCTACACAGGTGCCATCAAATTGGATGACAAAGATCCAAATTTCA |
| AAGATCAAGTCATTTTGCTGAATAAGCATATTGACGCATACAAAACATTCCCACCAACAGAGCCTAAAAAGGACAAAAGAAGAAGGCT |
| GATGAAACTCAAGCCTTACCGCAGAGACAGAAGAAACAGCAAACTGTGACTCTTCTTCCTGCTGCAGATTTGGATGATTTCTCCAAACAA |
| TTGCAACAATCCATGAGCAGTGCTGACTCAACTCAGGCCTAAACTCATGCAGACCACACAAGGCAGATGGCTATATAAACGTTTTCGCT |
| TTTCCGTTTACGATATATAGTCTACTCTTGTGCAGAATGAATTCTCGTAACTACATAGCACAAGTAGATGTAGTTAACTTTAATCTCACATA |
| GCAATCTTTAATCAGTGTGTAACATTAGGGAGGACTTGAAAGAGCCACCACATTTTCACCGAGGCCACGCGGAGTACGATCGAGTGTAC |
| AGTGAACAATGCTAGGGAGAGCTGCCTATATGGAAGAGCCCTAATGTGTAAAATTAATTTTAGTAGTGCTATCCCCATGTGATTTTAATA |
| GCTTCTTAGGAGNATGACANNNNNNNNNNNNNN |

>Severe acute respiratory syndrome coronavirus 2 orf1ab polyprotein of isolate hCoV-19/
Austria/CeMM0360/2020

SEQ ID NO: 16

MESLVPGFNEKTHVQLSLPVLQVRDVLVRGFGDSVEEVLSEARQHLKDGTCGLVEVEKGVLPQLEQPYVFIKRSDARTAPHGHVMVELVAELE

GIQYGRSGETLGVLVPHVGEIPVAYRKVLLRKNGNKGAGGHSYGADLKSFDLGDELGTDPYEDFQENWNTKHSSGVTRELMRELNGGAYTRY

VDNNFCGPDGYPLECIKDLLARAGKASCTLSEQLDFIDTKRGVYCCREHEHEIAWYTERSEKSYELQTPFEIKLAKKFDTFNGECPNFVFPLNSIIK

TIQPRVEKKKLDGFMGRIRSVYPVASPNECNQMCLSTLMKCDHCGETSWQTGDFVKATCEFCGTENLTKEGATTCGYLPQNAVVKIYCPACH

NSEVGPEHSLAEYHNESGLKTILRKGGRTIAFGGCVFSYVGCHNKCAYWVPRASANIGCNHTGVVGEGSEGLNDNLLEILQKEKVNINIVGDFK

LNEEIAIILASFSASTSAFVETVKGLDYKAFKQIVESCGNFKVTKGKAKKGAWNIGEQKSILSPLYAFASEAARVVRSIFSRTLETAQNSVRVLQKA

AITILDGISQYSLRLIDAMMFTSDLATNNLVVMAYITGGVVQLTSQWLTNIFGTVYEKLKPVLDWLEEKFKEGVEFLRDGWEIVKFISTCACEIV

GGQIVTCAKEIKESVQTFFKLVNKFLALCADSIIIGGAKLKALNLGETFVTHSKGLYRKCVKSREETGLLMPLKAPKEIIFLEGETLPTEVLTEEVVLK

TGDLQPLEQPTSEAVEAPLVGTPVCINGLMLLEIKDTEKYCALAPNMMVTNNTFTLKGGAPTKVTFGDDTVIEVQGYKSVNITFELDERIDKVL

NEKCSAYTVELGTEVNEFACVVADAVIKTLQPVSELLTPLGIDLDEWSMATYYLFDESGEFKLASHMYCSFYPPDEDEEEGDCEEEEFEPSTQYE

YGTEDDYQGKPLEFGATSAALQPEEEQEEDWLDDDSQQTVGQQDGSEDNQTTTIQTIVEVQPQLEMELTPVVQTIEVNSFSGYLKLTDNVYI

KNADIVEEAKKVKPTVVVNAANVYLKHGGGVAGALNKATNNAMQVESDDYIATNGPLKVGGSCVLSGHNLAKHCLHVVGPNVNKGEDIQL

LKSAYENFNQHEVLLAPLLSAGIFGADPIHSLRVCVDTVRTNVYLAVFDKNLYDKLVSSFLEMKSEKQVEQKIAEIPKEEVKPFITESKPSVEQRKQ

DDKKIKACVEEVTTTLEETKFLTENLLLYIDINGNLHPDSATLVSDIDITFLKKDAPYIVGDVVQEGVLTAVVIPTKKAGGTTEMLAKALRKVPTDN

YITTYPGQGLNGYTVEEAKTVLKKCKSAFYILPSIISNEKQEILGTVSWNLREMLAHAEETRKLMPVCVETKAIVSTIQRKYKGIKIQEGVVDYGAR

FYFYTSKTTVASLINTLNDLNETLVTMPLGYVTHGLNLEEAARYMRSLKVPATVSVSSPDAVTAYNGYLTSSSKTPEEHFIETISLAGSYKDWSYS

GQSTQLGIEFLKRGDKSVYYTSNPTTFHLDGEVITFDNLKTLLSLREVRTIKVFTTVDNINLHTQVVDMSMTYGQQFGPTYLDGADVTKIKPHNS

HEGKTFYVLPNDDTLRVEAFEYYHTTDPSFLGRYMSALNHTKKWKYPQVNGLTSIKWADNNCYLATALLTLQQIELKFNPPALQDAYYRARAG

EAANFCALILAYCNKTVGELGDVRETMSYLFQHANLDSCKRVLNVVCKTCGQQQTTLKGVEAVMYMGTLSYEQFKKGVQIPCTCGKQATKYL

VQQESPFVMMSAPPAQYELKHGTFTCASEYTGNYQCGHYKHITSKETLYCIDGALLTKSSEYKGPITDVFYKENSYTTTIKPVTYKLDGVVCTEID

PKLDNYYKKDNSYFTEQPIDLVPNQPYPNASFDNFKFVCDNIKFADDLNQLTGYKKPASRELKVTFFPDLNGDVVAIDYKHYTPSFKKGAKLLHK

| SEQUENCES |
| --- |
| PIVWHVNNATNKATYKPNTWCIRCLWSTKPVETSNSFDVLKSEDAQGMDNLACEDLKPVSEEVVENPTIQKDVLECNVKTTEVVGDIILKPAN |
| NSLKITEEVGHTDLMAAYVDNSSLTIKKPNELSRVLGLKTLATHGLAAVNSVPWDTIANYAKPFLNKVVSTTTNIVTRCLNRVCTNYMPYFFTLL |
| LQLCTFTRSTNSRIKASMPTTIAKNTVKSVGKFCLEASFNYLKSPNFSKLINIIIWFLLLSVCLGSLIYSTAALGVLMSNLGMPSYCTGYREGYLNST |
| NVTIATYCTGSIPCSVCLSGLDSLDTYPSLETIQITISSFKWDLTAFGLVAEWFLAYILFTRFFYVLGLAAIMQLFFSYFAVHFISNSWLMWLIINLV |
| QMAPISAMVRMYIFFASFYYVWKSYVHVVDGCNSSTCMMCYKRNRATRVECTTIVNGVRRSFYVYANGGKGFCKLHNWNCVNCDTFCAG |
| STFISDEVARDLSLQFKRPINPTDQSSYIVDSVTVKNGSIHLYFDKAGQKTYERHSLSHFVNLDNLRANNTKGSLPINVIVFDGKSKCEESSAKSAS |
| VYYSQLMCQPILLLDQALVSDVGDSAEVAVKMFDAYVNTFSSTFNVPMEKLKTLVATAEAELAKNVSLDNVLSTFISAARQGFVDSDVETKDV |
| VECLKLSHQSDIEVTGDSCNNYMLTYNKVENMTPRDLGACIDCSARHINAQVAKSHNIALIWNVKDFMSLSEQLRKQIRSAAKKNNLPFKLTC |
| ATTRQVVNVVTTKIALKGGKIVNNWLKQLIKVT

SEQUENCES

YDPLQPELDSFKEELDKYFKNHTSPDVDLGDISGINASVVNIQKEIDRLNEVAKNLNESLIDLQELGKYEQYIKWPWYIWLGFIAGLIAIVMVTIM

LCCMTSCCSCLKGCCSCGSCCKFDEDDSEPVLKGVKLHYT

>Severe acute respiratory syndrome coronavirus 2 isolate SARS-CoV-2/human/England/ex-SA/2021,
EVAg Ref-SKU: 004V-04071 (SA_P2) complete genome. South-African B.1.351 lineage

SEQ ID NO: 18

ATTAAAGGTTTATACCTTCCCAGGTAACAAACCAACCAACTTTCGATCTCTTGTAGATCTGTTCTCTAAACGAACTTTAAAAT

CTGTGTGGCTGTCACTCGGCTGCATGCTTAGTGCACTCACGCAGTATAATTAATAACTAATTACTGTCGTTGACAGGACAC

GAGTAACTCTTCTATCTTCTGCAGGCTGCTTACGGTTTCGTCCGTGTTGCAGCCGATCATCAGCACATCTAGGTTTTGTCCG

GGTGTGACCGAAAGGTAAGATGGAGAGCCTTGTCCCTGGTTTCAACGAGAAAACACACGTCCAACTCAGTTTGCCTGTTTT

ACAGGTTCGCGACGTGCTCGTACGTGGCTTTGGAGACTCCGTGGAGGAGGTCTTATCAGAGGCACGTCAACATCTTAAAG

ATGGCACTTGTGGCTTAGTAGAAGTTGAAAAAGGCGTTTTGCCTCAACTTGAACAGCCCTATGTGTTCATCAAACGTTCGG

ATGCTCGAACTGCACCTCATGGTCATGTTATGGTTGAGCTGGTAGCAGAACTCGAAGGCATTCAGTACGGTCGTAGTGGT

GAGACACTTGGTGTCCTTGTCCCTCATGTGGGCGAAATACCAGTGGCTTACCGCAAGGTTCTTCTTCGTAAGAACGGTAAT

AAAGGAGCTGGTGGCCATAGTTACGGCGCCGATCTAAAGTCATTTGACTTAGGCGACGAGCTTGGCACTGATCCTTATGA

AGATTTTCAAGAAAACTGGAACACTAAACATAGCAGTGGTGTTACCCGTGAACTCATGCGTGAGCTTAACGGAGGGGCAT

ACACTCGCTATGTCGATAACAACTTCTGTGGCCCTGATGGCTACCCTCTTGAGTGCATTAAAGACCTTCTAGCACGTGCTGG

TAAAGCTTCATGCACTTTGTCCGAACAACTGGACTTTATTGACACTAAGAGGGGTGTATACTGCTGCCGTGAACATGAGCA

TGAAATTGCTTGGTACACGGAACGTTCTGAAAAGAGCTATGAATTGCAGACACCTTTTGAAATTAAATTGGCAAAGAAATT

TGACATCTTCAATGGGAATGTCCAAATTTTGTATTTCCCTTAAATTCCATAATCAAGACTATTCAACCAAGGGTTGAAAAG

AAAAAGCTTGATGGCTTTATGGGTAGAATTCGATCTGTCTATCCAGTTGCGTCACCAAATGAATGCAACCAAATGTGCCTTT

CAACTCTCATGAAGTGTGATCATTGTGGTGAAACTTCATGGCAGACGGGCGATTTTGTTAAAGCCACTTGCGAATTTTGTG

GCACTGAGAATTTGACTAAAGAAGGTGCCACTACTTGTGGTTACTTACCCCAAAATGCTGTTGTTAAAATTTATTGTCCAGC

ATGTCACAATTCAGAAGTAGGACCTGAGCATAGTCTTGCCGAATACCATAATGAATCGGCTTGAAAACCATTCTTCGTAA

GGGTGGTCGCACTATTGCCTTTGGAGGCTGTGTGTTCTCTTATGTTGGTTGCCATAACAAGTGTGCCTATTGGGTTCCACGT

GCTAGCGCTAACATAGGTTGTAACCATACAGGTGTTGTTGGAGAAGGTTCCGAAGGTCTTAATGACAACCTTCTTGAAATA

CTCCAAAAGAGAAAGTCAACATCAATATTGTTGGTGACTTTAAACTTAATGAAGAGATCGCCATTATTTGGCATCTTTTT

CTGCTTCCACAAGTGCTTTTGTGGAAACTGTGAAAGGTTTGGATTATAAAGCATTCAAACAAATTGTTGAATCCTGTGGTA

ATTTTAAAGTTACAAAAGGAAAAGCTAAAAAAGGTGCCTGGAATATTGGTGAACAGAAATCAATACTGAGTCCTCTTTATG

CATTTGCATCAGAGGCTGCTCGTGTTGTACGATCAATTTTCTCCCGCACTCTTGAAACTGCTCAAAATTCTGTGCGTGTTTTA

CAGAAGGCCGCTATAACAATACTAGATGGAATTTCACAGTATTCACTGAGACTCATTGATGCTATGATGTTCACATCTGATT

TGGCTACTAACAATCTAGTTGTAATGGCCTACATTACAGGTGGTGTTGTTCAGTTGACTTCGCAGTGGCTAACTAACATCTT

TGGCACTGTTTATGAAAAACTCAAACCCGTCCTTGATTGGCTTGAAGAGAAGTTTAAGGAAGGTGTAGAGTTTCTTAGAGA

CGGTTGGGAAATTGTTAAATTTATCTCAACCTGTGCTTGTGAAATTGTCGGTGGACAAATTGTCACCTGTGCAAGGAAAT

TAAGGAGAGTGTTCAGACATTCTTTAAGCTTGTAAATAAATTTTTGGCTTTGTGTGCTGACTCTATCATTATTGGTGGAGCT

AAACTTAAAGCCTTGAATTTAGGTGAAACATTTGTCACGCACTCAAAGGGATTGTACAGAAAGTGTGTTAAATCCAGAGAA

GAAACTGGCCTACTCATGCCTCTAAAAGCCCCAAAAGAAATTATCTTCTTAGAGGGAGAAACACTTCCCACAGAAGTGTTA

ACAGAGGAAGTTGTCTTGAAAACTGGTGATTTACAACCATTAGAACAACCTACTAGTGAAGCTGTTGAAGCTCCATTGGTT

GGTACACCAGTTTGTATTAACGGGCTTATGTTGCTCGAAATCAAAGACACAGAAAAGTACTGTGCCCTTGCACCTAATATG

ATGGTAACTAACAATACCTTCACACTCAAAGGCGGTGCACCAACAAAGGTTACTTTTGGTGATGACACTGTGATAGAAGTG

CAAGGTTACAAGAGTGTGAATATCACTTTTGAACTTGATGAAAGGATTGATAAAGTACTTAATGAGAAGTGCTCTGCCTAT

| SEQUENCES |
|---|
| ACAGTTGAACTCGGTACAGAAGTAAATGAGTTCGCCTGTGTTGTGGCAGATGCTGTCATAAAAACTTTGCAACCAGTATCT |
| GAATTACTTACACCACTGGGCATTGATTTAGATGAGTGGAGTATGGCTACATACTACTTATTTGATGAGTCTGGTGAGTTTA |
| AATTGGCTTCACATATGTATTGTTCTTTTTACCCTCCAGATGAGGATGAAGAAGAAGGTGATTGTGAAGAAGAAGAGTTTG |
| AGCCATCAACTCAATATGAGTATGGTACTGAAGATGATTACCAAGGTAAACCTTTGGAATTTGGTGCCACTTCTGCTGCTCT |
| TCAACCTGAAGAAGAGCAAGAAGAAGATTGGTTAGATGATGATAGTCAACAAACTGTTGGTCAACAAGACGGCAGTGAG |
| GACAATCAGACAACTACTATTCAAACAATTGTTGAGGTTCAACCTCAATTAGAGATGGAACTTACACCAGTTGTTCAGACTA |
| TTGAAGTGAATAGTTTTTAGTGGTTATTTAAAACTTACTGACAATGTATACATTAAAAATGCAGACATTGTGGAAGAAGCTA |
| AAAAGGTAAAACCAACAGTGGTTGTTAATGCAGCCAATGTTTACCTTAAACATGGAGGAGGTGTTGCAGGAGCCTTAAAT |
| AAGGCTACTAACAATGCCATGCAAGTTGAATCTGATGATTACATAGCTACTAATGGACCACTTAAAGTGGGTGGTAGTTGT |
| GTTTTAAGCGGACACAATCTTGCTAAACACTGTCTTCATGTTGTCGGCCCAAATGTTAACAAAGGTGAAGACATTCAACTTC |
| TTAAGAGTGCTTATGAAAATTTTAATCAGCACGAAGTTCTACTTGCACCATTATTATCAGCTGGTATTTTTGGTGCTGACCCT |
| ATACATTCTTTAAGAGTTTGTGTAGATACTGTTCGCACAAATGTCTACTTAGCTGTCTTTGATAAAAATCTCTATGACAAACT |
| TGTTTCAAGCTTTTTGGAAATGAAGAGTGAAAAGCAAGTTGAACAAAAGATCGCTGAGATTCCTAAAGAGGAAGTTAAGC |
| CATTTATAACTGAAAGTAAACCTTCAGTTGAACAGAGAAAACAAGATGATAAGAAAATCAAAGCTTGTGTTGAAGAAGTT |
| ACAACAACTCTGGAAGAAACTAAGTTCCTCACAGAAAACTTGTTACTTTATATTGACATTAATGGCAATCTTCATCCAGATT |
| CTGCCACTCTTGTTAGTGACATTGACATCACTTTCTTAAAGAAAGATGCTCCATATATAGTGGGTGATGTTGTTCAAGAGGG |
| TGTTTTAACTGCTGTGGTTATACCTACTAAAAAGGCTGGTGGCACTACTGAAATGTTAGCGAAAGCTTTGAGAAAAGTGCC |
| AACAGACAATTATATAACCACTTACCCGGGTCAGGGTTTAAATGGTTACACTGTAGAGGAGGCAAAGACAGTGCTTAAAA |
| AGTGTAAAAGTGCCTTTTACATTCTACCATCTATTATCTCTAATGAGAAGCAAGAAATTCTTGGAACTGTTTCTTGGAATTTG |
| CGAGAAATGCTTGCACATGCAGAAGAAACACGCAAATTAATGCCTGTCTGTGTGGAAACTAAAGCCATAGTTTCAACTATA |
| CAGCGTAAATATAAGGGTATTAAAATACAAGAGGGTGTGGTTGATTATGGTGCTAGATTTTACTTTTACACCAGTAAAACA |
| ACTGTAGCGTCACTTATCAACACACTTAACGATCTAAATGAAACTCTTGTTACAATGCCACTTGGCTATGTAACACATGGCT |
| TAAATTTGGAAGAAGCTGCTCGGTATATGAGATCTCTCAAAGTGCCAGCTACAGTTTCTGTTTCTTCACCTGATGCTGTTAC |
| AGCGTATAATGGTTATCTTACTTCTTCTTCTAAAACACCTGAAGAACATTTTATTGAAACCATCTCACTTGCTGGTTCCTATA |
| AAGATTGGTCCTATTCTGGACAATCTACACAACTAGGTATAGAATTTCTTAAGAGAGGTGATAAAAGTGTATATTACACTA |
| GTAATCCTACCACATTCCACCTAGATGGTGAAGTTATCACCTTTGACAATCTTAAGACACTTCTTTCTTTGAGAGAAGTGAG |
| GACTATTAAGGTGTTTACAACAGTAGACAACATTAACCTCCACACGCAAGTTGTGGACATGTCAATGACATATGGCAACA |
| GTTTGGTCCAACTTATTTGGATGGAGCTGATGTTACTAAAATAAAACCTCATAATTCACATGAAGGTAAACATTTTATGTT |
| TTACCTAATGATGACACTCTACGTGTTGAGGCTTTTGAGTACTACCACACAACTGATCCTAGTTTTCTGGGTAGGTACATGT |
| CAGCATTAAATCACACTAAAAATTGGAAATACCCACAAGTTAATGGTTTAACTTCTATTAAATGGGCAGATAACAACTGTTA |
| TCTTGCCACTGCATTGTTAACACTCCAACAAATAGAGTTGAAGTTTAATCCACCTGCTCTACAAGATGCTTATTACAGAGCA |
| AGGGCTGGTGAAGCTGCTAACTTTTGTGCACTTATCTTAGCCTACTGTAATAAGACAGTAGGTGAGTTAGGTGATGTTAGA |
| GAAACAATGAGTTACTTGTTTCAACATGCCAATTTAGATTCTTGCAAAGAGTCTTGAACGTGGTGTGTAAAACTTGTGGA |
| CAACAGCAGACAACCCTTAAGGGTGTAGAAGCTGTTATGTACATGGGCACACTTTCTTATGAACAATTTAAGAAAGGTGTT |
| CAGATACCTTGTACGTGTGGTAAACAAGCTACAAAATATCTAGTACAACAGGAGTCACCTTTTGTTATGATGTCAGCACCA |
| CCTGCTCAGTATGAACTTAAGCATGGTACATTTACTTGTGCTAGTGAGTACACTGGTAATTACCAGTGTGGTCACTATAAAC |
| ATATAACTTCTAAAGAAACTTTGTATTGCATAGACGGTGCTTTACTTACAAAGTCCTCAGAATACAAAGGTCCTATTACGGA |
| TGTTTTCTACAAAGAAAACAGTTACACAACAACCATAAAACCAGTTACTTATAAATTGGATGGTGTTGTTTGTACAGAAATT |

| SEQUENCES |
|---|
| GACCCTAAGTTGGACAATTATTATAAGAAAGACAATTCTTATTTCACAGAGCAACCAATTGATCTTGTACCAAACCAACCAT |
| ATCCAAACGCAAGCTTCGATAATTTTAAGTTTGTATGTGATAATATCAAATTTGCTGATGATTTAAACCAGTTAACTGGTTA |
| CAAGAAACCTGCTTCAAGAGAGCTTAAAGTTACATTTTTCCCTGACTTAAATGGTGATGTGGTGGCTATTGATTATAAACAC |
| TACACACCCTCTTTTAAGAAAGGAGCTAAATTGTTACATAAACCTATTGTTTGGCATGTTAACAATGCAACTAATAAAGCCA |
| CGTATAAACCAAATACCTGGTGTATACGTTGTCTTTGGAGCACAAAACCAGTTGAAACATCAAATTCGTTTGATGTACTGAA |
| GTCAGAGGACGCGCAGGGAATGGATAATCTTGCCTGCGAAGATCTAAAACCAGTCTCTGAAGAAGTAGTGGAAAATCCTA |
| CCATACAGAAAGACGTTCTTGAGTGTAATGTGAAAACTACCGAAGTTGTAGGAGACATTATACTTAAACCAGCAAATAATA |
| GTTTAAAAATTACAGAAGAGGTTGGCCACACAGATCTAATGGCTGCTTATGTAGACAATTCTAGTCTTACTATTAAGAAAC |
| CTAATGAATTATCTAGAGTATTAGGTTTGAAAACCCTTGCTACTCATGGTTTAGCTGCTGTTAATAGTGTCCCTTGGGATAC |
| TATAGCTAATTATGCTAAGCCTTTTCTTAACAAAGTTGTTAGTACAACTACTAACATAGTTACACGGTGTTTAAACCGTGTTT |
| GTACTAATTATATGCCTTATTTCTTTACTTTATTGCTACAATTGTGTACTTTTACTAGAAGTACAAATTCTAGAATTAAAGCAT |
| CTATGCCGACTACTATAGCAAAGAATACTGTTAAGAGTGTCGGTAAATTTTGTCTAGAGGCTTCATTTAATTATTTGAAGTC |
| ACCTAATTTTTCTAAACTGATAAATATTATAATTTGGTTTTTACTATTAAGTGTTTGCCTAGGTTCTTTAATMTACTCAACCG |
| CTGCTTTAGGTGTTTTAATGTCTAATTTAGGCATGCCTTCTTACTGTACTGGTTACAGAGAAGGCTATTTGAACTCTACTAAT |
| GTCACTATTGCAACCTACTGTACTGGTTCTATACCTTGTAGTGTTTGTCTTAGTGGTTTAGATTCTTTAGACACCTATCCTTCT |
| TTAGAAACTATACAAATTACCATTTCATCTTTTAAATGGGATTTAACTGCTTTTGGCTTAGTTGCAGAGTGGTTTTTGGCATA |
| TATTCTTTTCACTAGGTTTTTCTATGTACTTGGATTGCTGCAATCATGCAATTGTTTTTCAGCTATTTTGCAGTACATTTTAT |
| TAGTAATTCTTGGCTTATGTGGTTAATAATTAATCTTGTACAAATGGCCCCGATTTCAGCTATGGTTAGAATGTACATCTTCT |
| TTGCATCATTTTATTATGTATGGAAAAGTTATGTGCATGTTGTAGACGGTTGTAATTCATCAACTTGTATGATGTGTTACAA |
| ACGTAATAGAGCAACAAGAGTCGAATGTACAACTATTGTTAATGGTGTTAGAAGGTCCTTTTATGTCTATGCTAATGGAGG |
| TAAAGGCTTTTGCAAACTACACAATTGGAATTGTGTTAATTGTGATACATTCTGTGCTGGTAGTACATTTATTAGTGATGAA |
| GTTGCGAGAGACTTGTCACTACAGTTTAAAAGACCAATAAATCCTACTGACCAGTCTTCTTACATCGTTGATAGTGTTACAG |
| TGAAGAATGGTTCCATCCATCTTTACTTTGATAAAGCTGGTCAAAAGACTTATGAAAGACATTCTCTCTCTCATTTTGTTAAC |
| TTAGACAACCTGAGAGCTAATAACACTAAAGGTTCATTGCCTATTAATGTTATAGTTTTTGATGGTAAATCAAATGTGAAG |
| AATCATCTGCAAAATCAGCGTCTGTTTACTACAGTCAGCTTATGTGTCAACCTATACTGTTACTAGATCAGGCATTAGTGTC |
| TGATGTTGGTGATAGTGCGGAAGTTGCAGTTAAAATGTTTGATGCTTACGTTAATACGTTTTCATCAACTTTTAACGTACCA |
| ATGGAAAAACTCAAAACACTAGTTGCAACTGCAGAAGCTGAACTTGCAAAGAATGTGTCCTTAGACAATGTCTTATCTACT |
| TTTATTTCAGCAGCTCGGCAAGGGTTTGTTGATTCAGATGTAGAAACTAAAGATGTTGTTGAATGTCTTAAATTGTCACATC |
| AATCTGACATAGAAGTTACTGGCGATAGTTGTAATAACTATATGCTCACCTATAACAAAGTTGAAAACATGACACCCCGTG |
| ACCTTGGTGCTTGTATTGACTGTAGTGCGCGTCATATTAATGCGCAGGTAGCAAAAAGTCACAACATTGCTTTGATATGGA |
| ACGTTAAAGATTTCATGTCATTGTCTGAACAACTACGAAAACAAATACGTAGTGCTGCTAAAAAGAATAACTTACCTTTTAA |
| GTTGACATGTGCAACTACTAGACAAGTTGTTAATGTTGTAACAACAAAGATAGCACTTAAGGGTGGTAAAATTGTTAATAA |
| TTGGTTGAAGCAGTTAATTAAAGTTACACTTGTGTTCCTTTTTGTTGCTGCTATTTTCTATTTAATAACACCTGTTCATGTCAT |
| GTCTAAACATACTGACTTTTCAAGTGAAATCATAGGATACAAGGCTATTGATGGTGGTGTCACTCGTGACATAGCATCTAC |
| AGATACTTGTTTTGCTAACAAACATGCTGATTTTGACACATGGTTTAGCCAGCGTGGTGGTAGTTATACTAATGACAAAGCT |
| TGCCCATTGATTGCTGCAGTCATAACAAGAGAAGTGGGTTTTGTCGTGCCTGGTTTGCCTGGCACGATATTACGCACAACT |
| AATGGTGACTTTTTGCATTTCTTACCTAGAGTTTTTAGTGCAGTTGGTAACATCGTTACACACCATCAAAACTTATAGAGTA |
| CACTGACTTTGCAACATCAGCTTGTGTTTTGGCTGCTGAATGTACAATTTTTAAAGATGCTTCTGGTAAGCCAGTACCATAT |
| TGTTATGATACCAATGTACTAGAAGGTTCTGTTGCTTATGAAAGTTTACGCCCTGACACACGTTATGTGCTCATGGATGGCT |

| SEQUENCES |
|---|
| CTATTATTCAATTTCCTAACACCTACCTTGAAGGTTCTGTTAGAGTGGTAACAACTTTTGATTCTGAGTACTGTAGGCACGG |
| CACTTGTGAAAGATCAGAAGCTGGTGTTTGTGTATCTACTAGTGGTAGATGGGTACTTAACAATGATTATTACAGATCTTTA |
| CCAGGAGTTTTCTGTGGTGTAGATGCTGTAAATTTATTTACTAATATGTTTACACCACTAATTCAACCTATTGGTGCTTTGGA |
| CATATCAGCATCTATAGTAGCTGGTGGTATTGTAGCTATCGTAGTAACATGCCTTGCCTACTATTTTATGAGGTTTAGAAGA |
| GCTTTTGGTGAATACAGTCATGTAGTTGCCTTTAATACTTTACTATTCCTTATGTCATTCACTGTACTCTGTTTAACACCAGTT |
| TACTCATTCTTACCTGGTGTTTATTCTGTTATTTACTTGTACTTGACATTTTATCTTACTAATGATGTTTCTTTTTTAGCACATA |
| TTCAGTGGATGGTTATGTTCACACCTTTAGTACCTTTCTGGATAACAATTGCTTATATCATTTGTATTTCCACAAAGCATTTCT |
| AUGGTTCTTTAGTAATTACCTAAAGAGACGTGTAGTCTTTAATGGTGTTTCCTTTAGTACTTTTGAAGAAGCTGCGCTGTG |
| CACCTTTTTGTTAAATAAAGAAATGTATCTAAAGTTGCGTAGTGATGTGCTATTACCTCTTACGCAATATAATAGATACTTA |
| GCTCTTTATAATAAGTACAAGTATTTTAGTGGAGCAATGGATACAACTAGCTACAGAGAAGCTGCTTGTTGTCATCTCGCA |
| AAGGCTCTCAATGACTTCAGTAACTCAGGTTCTGATGTTCTTTACCAACCACCACAAACCTCTATCACCTCAGCTGTTTTGCA |
| GAGTGGTTTTAGAAAAATGGCATTCCCATCTGGTAAAGTTGAGGGTTGTATGGTACAAGTAACTTGTGGTACAACTACACT |
| TAACGGTCTTTGGCTTGATGACGTAGTTTACTGTCCAAGACATGTGATCTGCACCTCTGAAGACATGCTTAACCCTAATTAT |
| GAAGATTTACTCATTCGTAAGTCTAATCATAATTTCTTGGTACAGGCTGGTAATGTTCAACTCAGGGTTATTGGACATTCTA |
| TGCAAAATTGTGTACTTAAGCTTAGGGTTGATACAGCCAATCCTAAGACACCTAAGTATAAGTTTGTTCGCATTCAACCAG |
| GACAGACTTTTTCAGTGTTAGCTTGTTACAATGGTTCACCATCTGGTGTTTACCAATGTGCTATGAGGCCCAATTTCACTATT |
| AAGGGTTCATTCCTTAATGGTTCATGTGGTAGTGTTGGTTTTAACATAGATTATGACTGTGTCTCTTTTTKTTACATGCACCA |
| TATGGAATTACCAACTGGAGTTCATGCTGGCACAGACTTAGAAGGTAACTTTTATGGACCTTTTGTTGACAGGCAAACAGC |
| ACAAGCAGCTGGTACGGACACAACTATTACAGTTAATGTTTTAGCTTGGTTGTACGCTGCTGTTATAAATGGAGACAGGTG |
| GTTTCTCAATCGATTTACCACAACTCTTAATGACTTTAACCTTGTGGCTATGAAGTACAATTATGAACYTCTAACACAAGACC |
| ATGTTGACATACTAGGACCTCTTTCTGCTCAAACTGGAATTGCCGTTTTAGATATGTGTGCTTCATTAAAAGAATTACTGCA |
| AAATGGTATGAATGGACGTACCATATTGGGTAGTGCTTTATTAGAAGATGAATTTACACCTTTTGATGTTGTTAGACAATG |
| CTCAGGTGTTACTTTCCAAAGTGCAGTGAAAAGAACAATCAAGGGTACACACCACTGGTTGTTACTCACAATTTTGACTTCA |
| CTTTTAGTTTTAGTCCAGAGTACTCAATGGTCTTTGTTCTTTTTTTTGTATGAAAATGCCTTTTTACCTTTTGCTATGGGTATT |
| ATTGCTATGTCTGCTTTTGCAATGATGTTTGTCAAACATAAGCATGCATTTCTCTGTTTGTTTTTGTTACCTTCTCTTGCCACT |
| GTAGCTTATTTTAATATGGTCTATATGCCTGCTAGTTGGGTGATGCGTATTATGACATGGTTGGATATGGTTGATACTAGTT |
| TGNNNNNNNAAGCTAAAAGACTGTGTTATGTATGCATCAGCTGTAGTGTTACTAATCCTTATGACAGCAAGAACTGTGTAT |
| GATGATGGTGCTAGGAGAGTGTGGACACTTATGAATGTCTTGACACTCGTTTATAAAGTTTATTATGGTAATGCTTTAGAT |
| CAAGCCATTTCCATGTGGGCTCTTATAATCTCTGTTACTTCTAACTACTCAGGTGTAGTTACAACTGTCATGTTTTTGGCCAG |
| AGGTATTGTTTTATGTGTGTTGAGTATTGCCCTATTTTCTTCATAACTGGTAATACACTTCAGTGTATAATGCTAGTTTATT |
| GTTTCTTAGGCTATTTTTGTACTTGTTACTTTGGCCTCTTTTGTTTACTCAACCGCTACTTTAGACTGACTCTTGGTGTTTATG |
| ATTACTTAGTTTCTACACAGGAGTTTAGATATATGAATTCACAGGGACTAYTCCCACCCAAGAATAGCATAGATGCCTTCAA |
| ACTCAACATTAAATTGTTGGGTGTTGGTGGCAAACCTTGTATCAAAGTAGCCACTGTACAGTCTAAAATGTCAGATGTAAA |
| GTGCACATCAGTAGTCTTACTCTCAGTTTTGCAACAACTCAGAGTAGAATCATCATCTAAATTGTGGGCTCAATGTGTCCAG |
| TTACACAATGACATTCTCTTAGCTAAAGATACTACTGAAGCCTTTGAAAAAATGGTTTCACTACTTTCTGTTTTGCTTTCCAT |
| GCAGGGTGCTGTAGACATAAACAAGCTTTGTGAAGAAATGCTGGACAACAGGGCAACCTTACAAGCTATAGCCTCAGAGT |
| TTAGTTCCCTTCCATCATATGCAGCTTTTGCTACTGCTCAAGAAGCTTATGAGCAGGCTGTTGCTAATGGTGATTCTGAAGT |
| TGTTCTTAAAAAGTTGAAGAAGTCTTTGAATGTGGCTAAATCTGAATTTGACCGTGATGCAGCCATGCAACGTAAGTTGGA |

| SEQUENCES |
|---|
| AAAGATGGCTGATCAAGCTATGACCCAAATGTATAAACAGGCTAGATCTGAGGACAAGAGGGCAAAAGTTACTAGTGCTA |
| TGCAGACAATGCTTTTCACTATGCTTAGAAAGTTGGATAATGATGCACTCAACAACATTATCAACAATGCAAGAGATGGTT |
| GTGTTCCCTTGAACATAATACCTCTTACAACAGCAGCCAAACTAATGGTTGTCATACCAGACTATAACACATATAAAAATAC |
| GTGTGATGGTACAACATTTACTTATGCATCAGCATTGTGGGAAATCCAACAGGTTGTAGATGCAGATAGTAAAATTGTTCA |
| ACTTAGTGAAATTAGTATGGACAATTCACCTAATTTAGCATGGCCTCTTATTGTAACAGCTTTAAGGGCCAATTCTGCTGTC |
| AAATTACAGAATAATGAGCTTAGTCCTGTTGCACTACGACAGATGTCTTGTGCTGCCGGTACTACACAAACTGCTTGCACT |
| GATGACAATGCGTTAGCTTACTACAACACAACAAAGGGAGGTAGGTTTGTACTTGCACTGTTATCCGATTTACAGGATTTG |
| AAATGGGCTAGATTCCCTAAGAGTGATGGAACTGGTACTATCTATACAGAACTGGAACCACCTTGTAGGTTTGTTACAGAC |
| ACACCTAAAGGTCCTAAAGTGAAGTATTTATACTTTATTAAAGGATTAAACAACCTAAATAGAGGTATGGTACTTGGTAGT |
| TTAGCTGCCACAGTACGTCTACAAGCTGGTAATGCAACAGAAGTGCCTGCCAATTCAACTGTATTATCTTTCTGTGCTTTTG |
| CTGTAGATGCTGCTAAAGCTTACAAAGATTATCTAGCTAGTGGGGGACAACCAATCACTAATTGTGTTAAGATGTTGTGTA |
| CACACACTGGTACTGGTCAGGCAATAACAGTTACACCGGAAGCCAATATGGATCAAGAATCCTTTGGTGGTGCATCGTGTT |
| GTCTGTACTGCCGTTGCCACATAGATCATCCAAATCCTAAAGGATTTTGTGACTTAAAAGGTAAGTATGTACAAATACCTAC |
| AACTTGTGCTAATGACCCTGTGGGTTTTACACTTAAAAACACAGTCTGTACCGTCTGCGGTATGTGGAAAGGTTATGGCTG |
| TAGTTGTGATCAACTCCGCGAACCCATGCTTCAGTCAGCTGATGCACAATCGTTTTTAAACGGGTTTGCGGTGTAAGTGCA |
| GCCCGTCTTACACCGTGCGGCACAGGCACTAGTACTGATGTCGTATACAGGGCTTTTGACATCTACAATGATAAAGTAGCT |
| GGTTTTGCTAAATTCCTAAAAACTAATTGTTGTCGCTTCCAAGAAAAGGACGAAGATGACAATTTAATTGATTCTTACTTTG |
| TAGTTAAGAGACACACTTTCTCTAACTACCAACATGAAGAAACAATTTATAATTTACTTAAGGATTGTCCAGCTGTTGCTAA |
| ACATGACTTCTTTAAGTTTAGAATAGACGGTGACATGGTACCACATATATCACGTCAACGTCTTACTAAATACACAATGGCA |
| GACCTCGTCTATGCTTTAAGGCATTTTGATGAAGGTAATTGTGACACATTAAAAGAAATACTTGTCACATACAATTGTTGTG |
| ATGATGATTATTTCAATAAAAAGGACTGGTATGATTTTGTAGAAAACCCAGATATATTACGCGTATACGCCAACTTAGGTG |
| AACGTGTACGCCAAGCTTTGTTAAAAACAGTACAATTCTGTGATGCCATGCGAAATGCTGGTATTGTTGGTGTACTGACAT |
| TAGATAATCAAGATCTCAATGGTAACTGGTATGATTTCGGTGATTTCATACAAACCACGCCAGGTAGTGGAGTTCCTGTTG |
| TAGATTCTTATTATTCATTGTTAATGCCTATATTAACCTTGACCAGGGCTTTAACTGCAGAGTCACATGTTGACACTGACTTA |
| ACAAAGCCTTACATTAAGTGGGATTTGTTAAAATATGACTTCACGGAAGAGAGGTTAAAACTCTTTGACCGTTATTTTAAAT |
| AUGGGATCAGACATACCACCCAAATTGTGTTAACTGTTTGGATGACAGATGCATTCTGCATTGTGCAAACTTTAATGTTTT |
| ATTCTCTACAGTGTTCCCACTTACAAGTTTTGGACCACTAGTGAGAAAAATATTTGTTGATGGTGTTCCATTTGTAGTTTCAA |
| CTGGATACCACTTCAGAGAGCTAGGTGTTGTACATAATCAGGATGTAAACTTACATAGCTCTAGACTTAGTTTTAAGGAAT |
| TACTTGTGTATGCTGCTGACCCTGCTATGCACGCTGCTTCTGGTAATCTATTACTAGATAAACGCACTACGTGCTTTTCAGT |
| AGCTGCACTTACTAACAATGTTGCTTTTCAAACTGTCAAACCCGGTAATTTTAACAAAGACTTCTATGACTTTGCTGTGTCTA |
| AGGGTTTCTTTAAGGAAGGAAGTTCTGTTGAATTAAAACACTTCTTCTTTGCTCAGGATGGTAATGCTGCTATCAGCGATTA |
| TGACTACTATCGTTATAATCTACCAACAATGTGTGATATCAGACAACTACTATTTGTAGTTGAAGTTGTTGATAAGTACTTT |
| GATTGTTACGATGGTGGCTGTATTAATGCTAACCAAGTCATCGTCAACAACCTAGACAAATCAGCTGGTTTTCCATTTAATA |
| AATGGGGTAAGGCTAGACTTTATTATGATTCAATGAGTTATGAGGATCAAGATGCACTTTTCGCATATACAAAACGTAATG |
| TCATCCCTACTATAACTCAAATGAATCTTAAGTATGCCATTAGTGCAAAGAATAGAGCTCGCACCGTAGCTGGTGTCTCTAT |
| CTGTAGTACTATGACCAATAGACAGTTTCATCAAAAATTATTGAAATCAATAGCCGCCACTAGAGGAGCTACTGTAGTAAT |
| TGGAACAAGCAAATTCTATGGTGGTTGGCACAACATGTTAAAAACTGTTTATAGTGATGTAGAAAACCCTCACCTTATGGG |
| TGGGATTATCCTAAATGTGATAGAGCCATGCCTAACATGCTTAGAATTATGGCCTCACTTGTTCTTGCTCGCAAACATACA |
| ACGTGTTGTAGCTTGTCACACCGTTTCTATAGATTAGCTAATGAGTGTGCTCAAGTATTGAGTGAAATGGTCATGTGTGGC |

```
GGTTCACTATATGTTAAACCAGGTGGAACCTCATCAGGAGATGCCACAACTGCTTATGCTAATAGTGTTTTAACATTTGTC

AAGCTGTCACGGCCAATGTTAATGCACTTTTATCTACTGATGGTAACAAAATTGCCGATAAGTATGTCCGCAATTTACAAC

ACAGACTTTATGAGTGTCTCTATAGAAATAGAGATGTTGACACAGACTTTGTGAATGAGTTTTACGCATATTTGCGTAAAC

ATTTCTCAATGATGATACTCTCTGACGATGCTGTTGTGTGTTTCAATAGCACTTATGCATCTCAAGGTCTAGTGGCTAGCAT

AAAGAACTTTAAGTCAGTTCTTTATTATCAAAACAATGTTTTTATGTCTGAAGCAAAATGTTGGACTGAGACTGACCTTACT

AAAGGACCTCATGAATTTTGCTCTCAACATACAATGCTAGTTAAACAGGGTGATGATTATGTGTACCTTCCTTACCCAGATC

CATCAAGAATCCTAGGGGCCGGCTGTTTTGTAGATGATATCGTAAAAACAGATGGTACACTTATGATTGAACGGTTCGTGT

CTTTAGCTATAGATGCTTACCCACTTACTAAACATCCTAATCAGGAGTATGCTGATGTCTTTCATTTGTACTTACAATACATA

AGAAAGCTACATGATGAGTTAACAGGACACATGTTAGACATGTATTCTGTTATGCTTACTAATGATAACACTTCAAGGTATT

GGGAACCTGAGTTTTATGAGGCTATGTACACACCGCATACAGTCTTACAGGCTGTTGGGCTTGTGTTCTTTGCAATTCAC

AGACTTCATTAAGATGTGGTGCTTGCATACGTAGACCATTCTTATGTTGTAAATGCTGTTACGACCATGTCATATCAACATC

ACATAAATTAGTCTTGTCTGTTAATCCGTATGTTTGCAATGCTTCAGGTTGTGATGTCACAGATGTGACTCAACTTTACTTAG

GAGGTATGAGCTATTATTGTAAATCACATAAACCACCCATTAGTTTTCCATTGTGTGCTAATGGACAAGTTTTTGGTTTATAT

AAAAATACATGTGTTGGTAGCGATAATGTTACTGACTTTAATGCAATTGCAACATGTGACTGGACAAATGCTGGTGATTAC

ATTTTAGCTAACACCTGTACTGAAAGACTCAAGCTTTTTGCAGCAGAAACGCTCAAAGCTACTGAGGAGACATTTAAACTG

TCTTATGGTATTGCTACTGTACGTGAAGTGCTGTCTGACAGAGAATTACATCTTTCATGGGAAGTTGGTAAACCTAGACCA

CCACTTAACCGAAATTATGTCTTTACTGGTTATCGTGTAACTAAAAACAGTAAAGTACAAATAGGAGAGTACACCTTTGAA

AAAGGTGACTATGGTGATGCTGTTGTTTACCGAGGTACAACAACTTACAAATTAAATGTTGGTGATTATTTTGTGCTGACAT

CACATACAGTAATGCCATTAAGTGCACCTACACTAGTGCCACAAGAGCACTATGTTAGAATTACTGGCTTATACCCAACACT

CAATATCTCAGATGAGTTTTCTAGCAATGTTGCAAATTATCAAAAGGTTGGTATGCAAAAGTATTCTACACTCCAGGGACCA

CCTGGTACTGGTAAGAGTCATTTTGCTATTGGCCTAGCTCTCTACTACCCTTCTGCTCGCATAGTGTATACAGCTTGCTCTCA

TGCCGCTGTTGATGCACTATGTGAGAAGGCATTAAAATATTTGCCTATAGATAAATGTAGTAGAATTATACCTGCACGTGC

TCGTGTAGAGTGTTTTGATAAATTCAAAGTGAATTCAACATTAGAACAGTATGTCTTTTGTACTGTAAATGCATTGCCTGAG

ACGACAGCAGATATAGTTGTCTTTGATGAAATTTCAATGGCCACAAATTATGATTTGAGTGTTGTCAATGCCAGATTACGT

GCTAAGCACTATGTGTACATTGGCGACCCTGCTCAATTACCTGCACCACGCACATTGCTAACTAAGGGCACACTAGAACCA

GAATATTTCAATTCAGTGTGTAGACTTATGAAAACTATAGGTCCAGACATGTTCCTCGGAACTTGTCGGCGTTGTCCTGCTG

AAATTGTTGACACTGTGAGTGCTTTGGTTTATGATAATAAGCTTAAAGCACATAAAGACAAATCAGCTCAATGCTTTAAAAT

GTTTTATAAGGGTGTTATCACGCATGATGTTTCATCTGCAATTAACAGGCCACAAATAGGCGTGGTAAGAGAATTCCTTAC

ACGTAACCCTGCTTGGAGAAAAGCTGTCTTTATTTCACCTTATAATTCACAGAATGCTGTAGCCTCAAAGATTTTGGGACTA

CCAACTCAAACTGTTGATTCATCACAGGGCTCAGAATATGACTATGTCATATTCACTCAAACCACTGAAACAGCTCACTCTT

GTAATGTAAACAGATTTAATGTTGCTATTACCAGAGCAAAAGTAGGCATACTTTGCATAATGTCTGATAGAGACCTTTATG

ACAAGTTGCAATTTACAAGTCTTGAAATTCCACGTAGGAATGTGGCAACTTTACAAGCTGAAAATGTAACAGGACTCTTTA

AAGATTGTAGTAAGGTAATCACTGGGTTACATCCTACACAGGCACCTACACACCTCAGTGTTGACACTAAATTCAAAACTG

AAGGTTTATGTGTTGACATACCTGGCATACCTAAGGACATGACCTATAGAAGACTCATCTCTATGATGGGTTTTAAAATGA

ATTATCAAGTTAATGGTTACCCTAACATGTTTATCACCCGCGAAGAAGCTATAAGACATGTACGTGCATGGATTGGCTTCG

ATGTCGAGGGGTGTCATGCTACTAGAGAAGCTGTTGGTACCAATTTACCTTTACAGCTAGGTTTTTCTACAGGTGTTAACCT

AGTTGCTGTACCTACAGGTTATGTTGATACACCTAATAATACAGATTTTTCCAGAGTTAGTGCTAAACCACCGCCTGGAGAT

CAATTTAAACACCTCATACCACTTATGTACAAAGGACTTCCTTGGAATGTAGTGCGTATAAAGATTGTACAAATGTTAAGTG
```

| SEQUENCES |
|---|
| ACACACTTAAAAATCTCTCTGACAGAGTCGTATTTGTCTTATGGGCACATGGCTTTGAGTTGACATCTATGAAGTATTTTGT |
| GAAAATAGGACCTGAGCGCACCTGTTGTCTATGTGATAGACGTGCCACATGCTTTTCCACTGCTTCAGACACTTATGCCTGT |
| TGGCATCATTCTATTGGATTTGATTACGTCTATAATCCGTTTATGATTGATGTTCAACAATGGGGTTTTACAGGTAACCTACA |
| AAGCAACCATGATCTGTATTGTCAAGTCCATGGTAATGCACATGTAGCTAGTTGTGATGCAATCATGACTAGGTGTCTAGC |
| TGTCCACGAGTGCTTTGTTAAGCGTGTTGACTGGACTATTGAATATCCTATAATTGGTGATGAACTGAAGATTAATGCGGC |
| TTGTAGAAAGGTTCAACACATGGTTGTTAAAGCTGCATTATTAGCAGACAAATTCCCAGTTCTTCACGACATTGGTAACCC |
| TAAAGCTATTAAGTGTGTACCTCAAGCTGATGTAGAATGGAAGTTCTATGATGCACAGCCTTGTAGTGACAAAGCTTATAA |
| AATAGAAGAATTATTCTATTCTTATGCCACACATTCTGACAAATTCACAGATGGTGTATGCCTATTTTGGAATTGCAATGTC |
| GATAGATATCCTGCTAATTCCATTGTTTGTAGATTTGACACTAGAGTGCTATCTAACCTTAACTTGCCTGGTTGTGATGGTG |
| GCAGTTTGTATGTAAATAAACATGCATTCCACACACCAGCTTTTGATAAAAGTGCTTTTGTTAATTTAAAACAATTACCATTT |
| TTCTATTACTCTGACAGTCCATGTGAGTCTCATGGAAAACAAGTAGTGTCAGATATAGATTATGTACCACTAAAGTCTGCTA |
| CGTGTATAACACGTTGCAATTTAGGTGGTGCTGTCTGTAGACATCATGCTAATGAGTACAGATTGTATCTCGATGCTTATAA |
| CATGATGATCTCAGCTGGCTTTAGCTTGTGGGTTTACAAACAATTTGATACTTATAACCTCTGGAACACTTTTACAAGACTTC |
| AGAGTTTAGAAAATGTGGCTTTTAATGTTGTAAATAAGGGACACTTTGATGGACAACAGGGTGAAGTACCAGTTTCTATCA |
| TTAATAACACTGTTTACACAAAAGTTGATGGTGTTGATGTAGAATTGTTTGAAAATAAAACAACATTACCTGTTAATGTAGC |
| ATTTGAGCTTTGGGCTAAGCGCAACATTAAACCAGTACCAGAGGTGAAAATACTCAATAATTTGGGTGTGGACATTGCTGC |
| TAATACTGTGATCTGGGACTACAAAAGAGATGCTCCAGCACATATATCTACTATTGGTGTTTGTTCTATGACTGACATAGCC |
| AAGAAACCAACTGAAACGATTTGTGCACCACTCACTGTCTTTTTTGATGGTAGAGTTGATGGTCAAGTAGACTTATTTAGA |
| AATGCCCGTAATGGTGTTCTTATTACAGAAGGTAGTGTTAAAGGTTTACAACCATCTGTAGGTCCCAAACAAGCTAGTCTT |
| AATGGAGTCACATTAATTGGAGAAGCCGTAAAAACACAGTTCAATTATTATAAGAAAGTTGATGGTGTTGTCCAACAATTA |
| CCTGAAACTTACTTTACTCAGAGTAGAAATTTACAAGAATTTAAACCCAGGAGTCAAATGGAAATTGATTTCTTAGAATTAG |
| CTATGGATGAATTCATTGAACGGTATAAATTAGAAGGCTATGCCTTCGAACATATCGTTTATGGAGATTTTAGTCATAGTCA |
| GTTAGGTGGTTTACATCTACTGATTGGACTAGCTAAACGTTTTAAGGAATCACCTTTTGAATTAGAAGATTTTATTCCTATG |
| GACAGTACAGTTAAAAACTATTTCATAACAGATGCGCAAACAGGTTCATCTAAGTGTGTGTGTTCTGTTATTGATTTATTAC |
| TTGATGATTTTGTTGAAATAATAAAATCCCAAGATTTATCTGTAGTTTCTAAGGTTGTCAAAGTGACTATTGACTATACAGA |
| AATTTCATTTATGCTTTGGTGTAAAGATGGCCATGTAGAAACATTTTACCCAAAATTACAATCTAGTCAAGCGTGGCAACCG |
| GGTGTTGCTATGCCTAATCTTTACAAAATGCAAAGAATGCTATTAGAAAAGTGTGACCTTCAAAATTATGGTGATAGTGCA |
| ACATTACCTAAAGGCATAATGATGAATGTCGCAAAATATACTCAACTGTGTCAATATTTAAACACATTAACATTAGCTGTAC |
| CCTATAATATGAGAGTTATACATTTTGGTGCTGGTTCTGATAAAGGAGTTGCACCAGGTACAGCTGTTTTAAGACAGTGGT |
| TGCCTACGGGTACGCTGCTTGTCGATTCAGATCTTAATGACTTTGTCTCTGATGCAGATTCAACTTTGATTGGTGATTGTGC |
| AACTGTACATACAGCTAATAAATGGGATCTCATTATTAGTGATATGTACGACCCTAAGACTAAAAATGTTACAAAAGAAAA |
| TGACTCTAAAGAGGGTTTTTTCACTTACATTTGTGGGTTTATACAACAAAAGCTAGCTCTTGGAGGTTCCGTGGCTATAAAG |
| ATAACAGAACATTCTTGGAATGCTGATCTTTATAAGCTCATGGGACACTTCGCATGGTGGACAGCCTTTGTTACTAATGTGA |
| ATGCGTCATCATCTGAAGCATTTTTAATTGGATGTAATTATCTTGGCAAACCACGCGAACAAATAGATGGTTATGTCATGCA |
| TGCAAATTACATATTTTGGAGGAATACAAATCCAATTCAGTTGTCTTCCTATTCTTTATTTGACATGAGTAAATTTCCCCTTA |
| AATTAAGGGGTACTGCTGTTATGTCTTTAAAAGAAGGTCAAATCAATGATATGATTTTATCTCTTCTTAGTAAAGGTAGACT |
| TATAATTAGAGAAAACAACAGAGTTGTTATTTCTAGTGATGTTCTTGTTAACAACTAAACGAACAATGTTTGTTTTTCTTGTT |
| TTATTGCCACTAGTCTCTAGTCAGTGTGTTAATCTTACAACCAGAACTCAATTACCCCCTGCATACACTAATTCTTTCACACG |
| TGGTGTTTATTACCCTGACAAAGTTTTCAGATCCTCAGTTTTACATTCAACTCAGGACTTGTTCTTACCTTTCTTTTCCAATGT |

| SEQUENCES |
|---|
| TACTTGGTTCCATGCTATACATGTCTCTGGGACCAATGGTACTAAGAGGTTTGCTAACCCTGTCCTACCATTTAATGATGGT |
| GTTTATTTTGCTTCCACTGAGAAGTCTAACATAATAAGAGGCTGGATTTTTGGTACTACTTTAGATTCGAAGACCCAGTCCC |
| TACTTATTGTTAATAACGCTACTAATGTTGTTATTAAAGTCTGTGAATTTCAATTTTGTAATGATCCATTTTTGGGTGTTTATT |
| ACCACAAAAACAACAAAAGTTGGATGGAAAGTGAGTTCAGAGTTTATTCTAGTGCGAATAATTGCACTTTTGAATATGTCT |
| CTCAGCCTTTTCTTATGGACCTTGAAGGAAAACAGGGTAATTTCAAAAATCTTAGGGAATTTGTGTTTAAGAATATTGATG |
| GTTATTTTAAAATATATTCTAAGCACACGCCTATTAATTTAGTGCGTGGTCTCCCTCAGGGTTTTTCGGCTTTAGAACCATTG |
| GTAGATTTGCCAATAGGTATTAACATCACTAGGTTTCAAANNNNNNCTTTACATAGAAGTTATTTGACTCCTGGTGATTCTT |
| CTTCAGGTTGGACAGCTGGTGCTGCAGCTTATTATGTGGGTTATCTTCAACCTAGGACTTTTCTATTAAAATATAATGAAA |
| ATGGAACCATTACAGATGCTGTAGACTGTGCACTTGACCCTCTCTCAGAAACAAAGTGTACGTTGAAATCCTTCACTGTAG |
| AAAAAGGAATCTATCAAACTTCTAACTTTAGAGTCCAACCAACAGAATCTATTGTTAGATTTCCTAATATTACAAACTTGTG |
| CCCTTTTGGTGAAGTTTTTAACGCCACCAGATTTGCATCTGTTTATGCTTGGAACAGGAAGAGAATCAGCAACTGTGTTGCT |
| GATTATTCTGTCCTATATAATTCCGCATCATTTTCCACTTTTAAGTGTTATGGAGTGTCTCCTACTAAATTAAATGATCTCTGC |
| TTTACTAATGTCTATGCAGATTCATTTGTAATTAGAGGTGATGAAGTCAGACAAATCGCTCCAGGGCAAACTGGAAATATT |
| GCTGATTATAATTATAAATTACCAGATGATTTTACAGGCTGCGTTATAGCTTGGAATTCTAACAATCTTGATTCTAAGGTTG |
| GTGGTAATTATAATTACCTGTATAGATGTTTAGGAAGTCTAATCTCAAACCTTTTGAGAGAGATATTTCAACTGAAATCTA |
| TCAGGCCGGTAGCACACCTTGTAATGGTGTTAAAGGTTTTAATTGTTACTTTCCTTTACAATCATATGGTTTCCAACCCACTT |
| ATGGTGTTGGTTACCAACCATACAGAGTAGTAGTACTTTCTTTTGAACTTCTACATGCACCAGCAACTGTTTGTGGACCTAA |
| AAAGTCTACTAATTTGGTTAAAAACAAATGTGTCAATTTCAACTTCAATGGTTTAACAGGCACAGGTGTTCTTACTGAGTCT |
| AACAAAAAGTTTCTGCCTTTCCAACAATTTGGCAGAGACATTGCTGACACTACTGATGCTGTCCGTGATCCACAGACACTTG |
| AGATTCTTGACATTACACCATGTTCTTTTGGTGGTGTCAGTGTTATAACACCAGGAACAAATACTTCTAACCAGGTTGCTGT |
| TCTTTATCAGGGTGTTAACTGCACAGAAGTCCCTGTTGCTATTCATGCAGATCAACTTACTCCTACTTGGCGTGTTTATTCTA |
| CAGGTTCTAATGTTTTTCAAACACGTGCAGGCTGTTTAATAGGGGCTGAACATGTCAACAACTCATATGAGTGTGACATAC |
| CCATTGGTGCAGGTATATGCGCTAGTTATCAGACTCAGACTAATTCTCCTCGGCGGGCACGTAGTGTAGCTAGTCAATCCA |
| TCATTGCCTACACTATGTCACTTGGTGTAGAAAATTCAGTTGCTTACTCTAATAACTCTATTGCCATACCCACAAATTTTACT |
| ATTAGTGTTACCACAGAAATTCTACCAGTGTCTATGACCAAGACATCAGTAGATTGTACAATGTACATTTGTGGTGATTCAA |
| CTGAATGCAGCAATCTTTTGTTGCAATATGGCAGTTTTTGTACACAATTAAACCGTGCTTTAACTGGAATAGCTGTTGAACA |
| AGACAAAAACACCCAAGAAGTTTTTGCACAAGTCAAACAAATTTACAAAACACCACCAATTAAAGATTTTGGTGGTTTTAA |
| TTTTTCACAAATATTACCAGATCCATCAAAACCAAGCAAGAGGTCATTTATTGAAGATCTACTTTTCAACAAAGTGACACTT |
| GCAGATGCTGGCTTCATCAAACAATATGGTGATTGCCTTGGTGATATTGCTGCTAGAGACCTCATTTGTGCACAAAAGTTT |
| AACGGCCTTACTGTTTTGCCACCTTTGCTCACAGATGAAATGATTGCTCAATACACTTCTGCACTGTTAGCGGGTACAATCA |
| CTTCTGGTTGGACCTTTGGTGCAGGTGCTGCATTACAAATACCATTTGCTATGCAAATGGCTTATAGGTTTAATGGTATTGG |
| AGTTACACAGAATGTTCTCTATGAGAACCAAAAATTGATTGCCAACCAATTTAATAGTGCTATTGGCAAAATTCAAGACTCA |
| CTTTCTTCCACAGCAAGTGCACTTGGAAAACTTCAAGATGTGGTCAACCAAAATGCACAAGCTTTAAACACGCTTGTTAAAC |
| AACTTAGCTCCAATTTTGGTGCAATTTCAAGTGTTTTAAATGATATCCTTTCACGTCTTGACAAAGTTGAGGCTGAAGTGCA |
| AATTGATAGGTTGATCACAGGCAGACTTCAAAGTTTGCAGACATATGTGACTCAACAATTAATTAGAGCTGCAGAAATCAG |
| AGCTTCTGCTAATCTTGCTGCTACTAAAATGTCAGAGTGTGTACTTGGACAATCAAAAAGAGTTGATTTTTGTGGAAAGGG |
| CTATCATCTTATGTCCTTCCCTCAGTCAGCACCTCATGGTGTAGTCTTCTTGCATGTGACTTATGTCCCTGCACAAGAAAAGA |
| ACTTCACAACTGCTCCTGCCATTTGTCATGATGGAAAAGCACACTTTCCTCGTGAAGGTGTCTTTGTTTCAAATGGCACACA |

| SEQUENCES |
|---|
| CTGGTTTGTAACACAAAGGAATTTTTATGAACCACAAATCATTACTACAGACAACACATTTGTGTCTGGTAACTGTGATGTT |
| GTAATAGGAATTGTCAACAACACAGTTTATGATCCTTTGCAACCTGAATTAGACTCATTCAAGGAGGAGTTAGATAAATAT |
| TTTAAGAATCATACATCACCAGATGTTGATTTAGGTGACATCTCTGGCATTAATGCTTCAGTTGTAAACATTCAAAAAGAAA |
| TTGACCGCCTCAATGAGGTTGCCAAGAATTTAAATGAATCTCTCATCGATCTCCAAGAACTTGGAAAGTATGAGCAGTATA |
| TAAAATGGCCATGGTACATTTGGCTAGGTTTTATAGCTGGCTTGATTGCCATAGTAATGGTGACAATTATGCTTTGCTGTAT |
| GACCAGTTGCTGTAGTTGTCTCAAGGGCTGTTGTTCTTGTGGATCCTGCTGCAAATTTGATGAAGACGACTCTGAGCCAGT |
| GCTCAAAGGAGTCAAATTACATTACACATAAACGAACTTATGGATTTGTTTATGAGAATCTTCACAATTGGAACTGTAACTT |
| TGAAGCAAGGTGAAATCAAGGATGCTACTCCTTCAGATTTTGTTCGCGCTACTGCAACGATACCGATACAAGCCTCACTCC |
| CTTTCGGATGGCTTATTGTTGGCGTTGCACTTCTTGCTGTTTTTCATAGCGCTTCCAAAATCATAACCCTCAAAAAGAGATG |
| GCAACTAGCACTCTCCAAGGGTGTTCACTTTGTTTGCAACTTGCTGTTGTTGTTTGTAACAGTTTACTCACACCTTTTGCTCG |
| TTGCTGCTGGCCTTGAAGCCCCTTTTCTCTATCTTTATGCTTTAGTCTACTTCTTGCAGAGTATAAACTTTGTAAGAATAATA |
| ATGAGGCTTTGGCTTTGCTGGAAATGCCGTTCCAAAAACCCATTACTTTATGATGCCAACTATTTTCTTTGCTGGCATACTAA |
| TTGTTACGACTATTGTATACCTTACAATAGTGTAACTTCTTCAATTGTCATTACTTTAGGTGATGGCACAACAAGTCCTATTT |
| CTGAACATGACTACCAGATTGGTGGTTATACTGAAAAATGGGAATCTGGAGTAAAAGACTGTGTTGTATTACACAGTTACT |
| TCACTTCAGACTATTACCAGCTGTACTCAACTCAATTGAGTACAGACACTGGTGTTGAACATGTTACCTTCTTCATCTACAAT |
| AAAATTGTTGATGAGCCTGAAGAACATGTCCAAATTCACACAATCGACGGTTCATCCGGAGTTGTTAATCCAGTAATGGAA |
| CCAATTTATGATGAACCGACGACGACTACTAGCGTGCCTTTGTAAGCACAAGCTGATGAGTACGAACTTATGTACTCATTC |
| GTTTCGGAAGAGACAGGTACGTTAATAGTTAATAGCGTACTTCTTTTTCTTGCTTTCGTGGTATTCTTGCTAGTTACACTAGC |
| CATCCTTACTGCGCTTCGATTGTGTGCGTACTGCTGCAATATTGTTAACGTGAGTCTTGTAAAACCTTCTTTTTACGTTTACT |
| CTCGTGTTAAAAATCTGAATTCTTCTAGAGTTCTTGATCTTCTGGTCTAAACGAACTAAATATTATATTAGTTTTTCTGTTTGG |
| AACTTTAATTTTAGCCATGGCAGATTCCAACGGTACTATTACCGTTGAAGAGCTTAAAAAGCTCCTTGAACAATGGAACCTA |
| GTAATAGGTTTCCTATTCCTTACATGGATTTGTCTTCTACAATTTGCCTATGCCAACAGGAATAGGTTTTTGTATATAATTAA |
| GTTAATTTTCCTCTGGCTGTTATGGCCAGTAACTTTAGCTTGTTTTGTGCTTGCTGCTGTTTACAGAATAAATTGGATCACCG |
| GTGGAATTGCTATCGCAATGGCTTGTCTTGTAGGCTTGATGTGGCTCAGCTACTTCATTGCTTCTTTCAGACTGTTTGCGCG |
| TACGCGTTCCATGTGGTCATTCAATCCAGAAACTAACATTCTTCTCAACGTGCCACTCCATGGCACTATTCTGACCAGACCG |
| CTTCTAGAAAGTGAACTCGTAATCGGAGCTGTGATCCTTCGTGGACATCTTCGTATTGCTGGACACCATCTAGGACGCTGT |
| GACATCAAGGACCTGCCTAAAGAAATCACTGTTGCTACATCACGAACGCTTTCTTATTACAAATTGGGAGCTTCGCAGCGT |
| GTAGCAGGTGACTCAGGTTTTGCTGCATACAGTCGCTACAGGATTGGCAACTATAAATTAAACACAGACCATTCCAGTAGC |
| AGTGACAATATTGCTTTGCTTGTACAGTAAGCGACAACAGATGTTTCATCTCGTTGACTTTCAGGTTACTATAGCAGAGATA |
| TTACTAATTATTATGAGGACTTTTAAAGTTTCCATTTGGAATCTTGATTACATCATAAACCTCATAATTAAAAATTTATCTAA |
| GTCACTAACTGAGAATAAATATTCTCAATTAGATGAAGAGCAACCAATGGAGATTGATTAAACGAACATGAAAATTATTCT |
| TTTCTTGGCACTGATAACACTCGCTACTTGTGAGCTTTATCACTACCAAGAGTGTGTTAGAGGTACAACAGTACTTTTAAAA |
| GAACCTTGCTCTTCTGGAACATACGAGGGCAATTCACCATTTCATCCTCTAGCTGATAACAAATTTGCACTGACTTGCTTTA |
| GCACTCAATTTGCTTTTGCTTGTCCTGACGGCGTAAAACACGTCTATCAGTTACGTGCCAGATCAGTTTCACCTAAACTGTTC |
| ATCAGACAAGAGGAAGTTCAAGAACTTTACTCTCCAATTTTTCTTATTGTTGCGGCAATAGTGTTTATAACACTTTGCTTCAC |
| ACTCAAAAGAAAGACAGAATGATTGAACTTTCATTAATTGACTTCTATTTGTGCTTTTAGCCTTTCTGCTATTCCTTGTTTTA |
| ATTATGCTTATTATCTTTTGGTTCTCACTTGAACTGCAAGATCATAATGAAACTTGTCACGCCTAAACGAACATGAAATTTCT |
| TGTTTTCTTAGGAATCATCACAACTGTAGCTGCATTTCACCAAGAATGTAGTTTACAGTCATGTACTCAACATCAACCATAT |
| GTAGTTGATGACCCGTGTCCTATTCACTTCTATTCTAAATGGTATATTAGAGTAGGAGCTAGAAAATCAGCACCTTTAATTG |

| SEQUENCES |
|---|
| AATTGTGCGTGGATGAGGCTGGTTCTAAATCACCCATTCAGTACATCGATATCGGTAATTATACAGTTTCCTGTTTACCTTTT |
| ACAATTAATTGCCAGGAACCTAAATTGGGTAGTCTTGTAGTGCGTTGTTCGTTCTATGAAGACTTTTTAGAGTATCATGACG |
| TTCGTGTTGTTTTAGATTTTATCTAAACGAACAAACTAAAATGTCTGATAATGGACCCCAAAATCAGCGAAATGCACCCCGC |
| ATTACGTTTGGTGGACCCTCAGATTCAACTGGCAGTAACCAGAATGGAGAACGCAGTGGGGCGCGATCAAAACAACGTCG |
| GCCCCAAGGTTTACCCAATAATACTGCGTCTTGGTTCACCGCTCTCACTCAACATGGCAAGGAAGACCTTAAATTCCCTCGA |
| GGACAAGGCGTTCCAATTAACACCAATAGCAGTCCAGATGACCAAATTGGCTACTACCGAAGAGCTACCAGACGAATTCG |
| TGGTGGTGACGGTAAAATGAAAGATCTCAGTCCAAGATGGTATTTCTACTACCTAGGAACTGGGCCAGAAGCTGGACTT |
| CCCTATGGTGCTAACAAAGACGGCATCATATGGGTTGCAACTGAGGGAGCCTTGAATACACCAAAAGATCACATTGGCAC |
| CCGCAATCCTGCTAACAATGCTGCAATCGTGCTACAACTTCCTCAAGGAACAACATTGCCAAAAGGCTTCTACGCAGAAGG |
| GAGCAGAGGCGGCAGTCAAGCCTCTTCTCGTTCCTCATCACGTAGTCGCAACAGTTCAAGAAATTCAACTCCAGGCAGCAG |
| TAGGGGAATTTCTCCTGCTAGAATGGCTGGCAATGGCGGTGATGCTGCTCTTGCTTTGCTGCTGCTTGACAGATTGAACCA |
| GCTTGAGAGCAAAATGTCTGGTAAAGGCCAACAACAACAAGGCCAAACTGTCACTAAGAAATCTGCTGCTGAGGCTTCTA |
| AGAAGCCTCGGCAAAAACGTACTGCCACTAAAGCATACAATGTAACACAAGCTTTCGGCAGACGTGGTCCAGAACAAACC |
| CAAGGAAATTTTGGGGACCAGGAACTAATCAGACAAGGAACTGATTACAAACATTGGCCGCAAATTGCACAATTTGCCCC |
| CAGCGCTTCAGCGTTCTTCGGAATGTCGCGCATTGGCATGGAAGTCACACCTTCGGGAACGTGGTTGACCTACACAGGTG |
| CCATCAAATTGGATGACAAAGATCCAAATTTCAAAGATCAAGTCATTTTGCTGAATAAGCATATTGACGCATACAAAACATT |
| CCCACCAACAGAGCCTAAAAAGGACAAAAAGAAGAAGGCTGATGAAACTCAAGCCTTACCGCAGAGACAGAAGAAACAG |
| CAAACTGTGACTCTTCTTCCTGCTGCAGATTTGGATGATTTCTCCAAACAATTGCAACAATCCATGAGCAGTGCTGACTCAA |
| CTCAGGCCTAAAACTCATGCAGACCACACAAGGCAGATGGGCTATATAAACGTTTTCGCTTTTCCGTTTACGATATATAGTCT |
| ACTCTTGTGCAGAATGAATTCTCGTAACTACATAGCACAAGTAGATGTAGTTAACTTTAATCTCACATAGCAATCTTTAATC |
| AGTGTGTAACATTAGGGAGGACTTGAAAGAGCCACCACATTTTCACCGAGGCCACGCGGAGTACGATCGAGTGTACAGTG |
| AACAATGCTAGGGAGAGCTGCCTATATGGAAGAGCCCTAATGTGTAAAATTAATTTTAGTAGTGCTATCCCCATGNNNNN |
| NNNNNNNNNNNNNNNNNNNNNNNNAAAAAAAAAAAAAAAAAAAAAAAAAAAAAAAAA |
| >SA_P2_gp02 surface glycoprotein, from genome accession SA_P2_t0.9_q20 |
| MFVFLVLLPLVSSQCVNLTTRTQLPPAYTNSFTRGVYYPDKVFRSSVLHSTQDLFLPFFSNVTWFHAIHVSGTNGTKRFANPVLPF |
| NDGVYFASTEKSNIIRGWIFGTTLDSKTQSLLIVNNATNVVIKVCEFQFCNDPFLGVYYHKNNKSWMESEFRVYSSANNCTFEYV |
| SQPFLMDLEGKQGNFKNLREFVFKNIDGYFKIYSKHTPINLVRGLPQGFSALEPLVDLPIGINITRFQXXXLHRSYLTPGDSSSGWT |
| AGAAAYYVGYLQPRTFLLKYNENGTITDAVDCALDPLSETKCTLKSFTVEKGIYQTSNFRVQPTESIVRFPNITNLCPFGEVFNATR |
| FASVYAWNRKRISNCVADYSVLYNSASFSTFKCYGVSPTKLNDLCFTNVYADSFVIRGDEVRQIAPGQTGNIADYNYKLPDDFTG |
| CVIAWNSNNLDSKVGGNYNYLYRLFRKSNLKPFERDISTEIYQAGSTPCNGVKGFNCYFPLQSYGFQPTYGVGYQPYRVVVLSFE |
| LLHAPATVCGPKKSTNLVKNKCVNFNFNGLTGTGVLTESNKKFLPFQQFGRDIADTTDAVRDPQTLEILDITPCSFGGVSVITPGT |
| NTSNQVAVLYQGVNCTEVPVAIHADQLTPTWRVYSTGSNVFQTRAGCLIGAEHVNNSYECDIPIGAGICASYQTQTNSPRRARS |
| VASQSIIAYTMSLGVENSVAYSNNSIAIPTNFTISVTTEILPVSMTKTSVDCTMYICGDSTECSNLLLQYGSFCTQLNRALTGIAVEQ |
| DKNTQEVFAQVKQIYKTPPIKDFGGFNFSQILPDPSKPSKRSFIEDLLFNKVTLADAGFIKQYGDCLGDIAARDLICAQKFNGLTVL |
| PPLLTDEMIAQYTSALLAGTITSGWTFGAGAALQIPFAMQMAYRFNGIGVTQNVLYENQKLIANQFNSAIGKIQDSLSSTASALG |
| KLQDVVNQNAQALNTLVKQLSSNFGAISSVLNDILSRLDKVEAEVQIDRLITGRLQSLQTYVTQQLIRAAEIRASANLAATKMSEC |
| VLGQSKRVDFCGKGYHLMSFPQSAPHGVVFLHVTYVPAQEKNFTTAPAICHDGKAHFPREGVFVSNGTHWFVTQRNFYEPQII |
| TTDNTFVSGNCDVVIGIVNNTVYDPLQPELDSFKEELDKYFKNHTSPDVDLGDISGINASVVNIQKEIDRLNEVAKNLNESLIDLQE |

SEQ ID NO: 19

| SEQUENCES |
|---|
| LGKYEQYIKWPWYIWLGFIAGLIAIVMVTIMLCCMTSCCSCLKGCCSCGSCCKFDEDDSEPVLKGVKLHYT |
| >MW520923.1 Severe acute respiratory syndrome coronavirus 2 isolate SARS-CoV-2/human/USA/MN-MDH-2399/2021, complete genome, example fo Brazilian P1 lineage.     SEQ ID NO: 20 |
| CAACTTTCGATCTCTTGTAGATCTGTTCTCTAAACGAACTTTAAAATCTGTGTGGCTGTCACTCGGCTGCATGCTTAGTG |
| CACTCACGCAGTATAATTAATAACTAATTACTGTCGTTGACAGGACACGAGTAACTCGTCTATCTTCTGCAGGCTGCTTA |
| CGGTTTCGTCCGTGTTGCAGCCGATCATCAGCACATCTAGGTTTTGTCCGGGTGTGACCGAAAGGTAAGATGGAGAGCCT |
| TGTCCCTGGTTTCAACGAGAAAACACACGTCCAACTCAGTTTGCCTGTTTTACAGGTTCGCGACGTGCTCGTACGTGGCT |
| TTGGAGACTCCGTGGAGGAGGTCTTATCAGAGGCACGTCAACATCTTAAAGATGGCACTTGTGGCTTAGTAGAAGTTGAA |
| AAAGGCGTTTTGCCTCAACTTGAACAGCCCTATGTGTTCATCAAACGTTCGGATGCTCGAACTGCACCTCATGGTCATGT |
| TATGGTTGAGCTGGTAGCAGAACTCGAAGGCATTCAGTACGGTCGTAGTGGTGAGACACTTGGTGTCCTTGTCCCTCATG |
| TGGGCGAAATACCAGTGGCTTACCGCAAGGTTCTTCTTCGTAAGAACGGTAATAAAGGAGCTGGTGGCCATAGTTACGGC |
| GCCGATCTAAAGTCATTTGACTTAGGCGACGAGCTTGGCACTGATCCTTATGAAGACTTTCAAGAAAACTGGAACACTAA |
| ACATAGCAGTGGTGTTACCCGTGAACTCATGCGTGAGCTTAACGGAGGGGCATACACTCGCTATGTCGATAACAACTTCT |
| GTGGCCCTGATGGCTACCCTCTTGAGTGCATTAAAGACCTTCTAGCACGTGCTGGTAAAGCTTCATGCACTTTGTCCGAA |
| CAACTGGACTTTATTGACACTAAGAGGGGTGTATACTGCTGCCGTGAACATGAGCATGAAATTGCTTGGTACACGGAACG |
| TTCTGAAAAGAGCTATGAATTGCAGACACCTTTTGAAATTAAATTGGCAAAGAAATTTGACACCTTCAATGGGGAATGTC |
| CAAATTTTGTATTTCCCTTAAATTCCATAATCAAGACTATTCAACCAAGGGTTGAAAAGAAAAAGCTTGATGGCTTTATG |
| GGTAGAATTCGATCTGTCTATCCAGTTGCGTCACCAAATGAATGCAACCAAATGTGCCTTTCAACTCTCATGAAGTGTGA |
| TCATTGTGGTGAAACTTCATGGCAGACGGGCGATTTTGTTAAAGCCACTTGCGAATTTTGTGGCACTGAGAATTTGACTA |
| AAGAAGGTGCCACTACTTGTGGTTACTTACCCCAAAATGCTGTTGTTAAAATTTATTGTCCAGCATGTCACAATTCAGAA |
| GTAGGACCTGAGCATAGTCTTGCCGAATACCATAATGAATCTGGCTTGAAAACCATTCTTCGTAAGGGTGGTCGCACTAT |
| TGCCTTTGGAGGCTGTGTGTTCTCTTATGTTGGTTGCCATAACAAGTGTGCCTATTGGGTTCCACGTGCTAGCGCTAACA |
| TAGGTTGTAACCATACAGGTGTTGTTGGAGAAGGTTCCGAAGGTCTTAATGACAACCTTCTTGAAATACTCCAAAAAGAG |
| AAAGTCAACATCAATATTGTTGGTGACTTTAAACTTAATGAAGAGATCGCCATTATTTTGGCATCTTTTTCTGCTTCCAC |
| AAGTGCTTTTGTGGAAACTGTGAAAGGTTTGGATTATAAAGCATTCAAACAAATTGTTGAATCCTGTGGTAATTTTAAAG |
| TTACAAAAGGAAAAGCTAAAAAAGGTGCCTGGAATATTGGTGAACAGAAATCAATACTGAGTCCTCTTTATGCATTTGCA |
| TCAGAGGCTGCTCGTGTTGTACGATCAATTTTCTCCCGCACTCTTGAAACTGCTCAAAATTCTGTGCGTGTTTTACAGAA |
| GGCCGCTATAACAATACTAGATGGAATTTCACAGTATTCACTGAGACTCATTGATGCTATGATGTTCACATCTGATTTGG |
| CTACTAACAATCTAGTTGTAATGGCCTACATTACAGGTGGTGTTGTTCAGTTGACTTCGCAGTGGCTAACTAACATCTTT |
| GGCACTGTTTATGAAAAACTCAAACCCGTCCTTGATTGGCTTGAAGAGAAGTTTAAGGAAGGTGTAGAGTTTCTTAGAGA |
| CGGTTGGGAAATTGTTAAATTTATCTCAACCTGTGCTTGTGAAATTGTCGGTGGACAAATTGTCACCTGTGCAAAGGAAA |
| TTAAGGAGAGTGTTCAGACATTCTTTAAGCTTGTAAATAAATTTTTGGCTTTGTGTGCTGACTCTATCATTATTGGTGGA |
| GCTAAACTTAAAGCCTTGAATTTAGGTGAAACATTTGTCACGCACTCAAAGGGATTGTACAGAAAGTGTGTTAAATCCAG |
| AGAAGAAACTGGCCTACTCATGCCTCTAAAAGCCCCAAAAGAAATTATCTTCTTAGAGGGAGAAACACTTCCCACAGAAG |
| TGTTAACAGAGGAAGTTGTCTTGAAAACTGGTGATTTACAACCATTAGAACAACCTACTAGTGAAGCTGTTGAAGCTCCA |
| TTGGTTGGTACACCAGTTTGTATTAACGGGCTTATGTTGCTCGAAATCAAAGACACAGAAAGTACTGTGCCCTTGCACC |
| TAATATGATGGTAACAAACAATACCTTCACACTCAAAGGCGGTGCACCAACAAAGGTTACTTTTGGTGATGATACTGTGA |
| TAGAAGTGCAAGGTTACAAGAGTGTGAATATCACTTTTGAACTTGATGAAAGGATTGATAAAGTACTTAATGAGAAGTGC |
| TCTGCCTATACAGTTGAACTCGGTACAGAAGTAAATGAGTTCGCCTGTGTTGTGGCAGATGCTGTCATAAAAACTTTGCA |

| SEQUENCES |
|---|
| ACCAGTATCTGAATTACTTACACCACTGGGCATTGATTTAGATGAGTGGAGTATGGCTACATACTACTTATTTGATGAGT |
| CTGGTGAGTTTAAATTGGCTTCACATATGTATTGTTCTTTTTACCCTCCAGATGAGGATGAAGAAGAAGGTGATTGTGAA |
| GAAGAAGAGTTTGAGCCATCAACTCAATATGAGTATGGTACTGAAGATGATTACCAAGGTAAACCTTTGGAATTTGGTGC |
| CACTTCTGCTGCTCTTCAACCTGAAGAAGAGCAAGAAGAAGATTGGTTAGATGATGATAGTCAACAAACTGTTGGTCAAC |
| AAGACGGCAGTGAGGACAATCAGACAACTACTATTCAAACAATTGTTGAGGTTCAACCTCAATTAGAGATGGAACTTACA |
| CCAGTTGTTCAGACTATTGAAGTGAATAGTTTTAGTGGTTATTTAAAACTTACTGACAATGTATACATTAAAAATGCAGA |
| CATTGTGGAAGAAGCTAAAAAGGTAAAACCAACAGTGGTTGTTAATGCAGCCAATGTTTACCTTAAACATGGAGGAGGTG |
| TTGCAGGAGCCTTAAATAAGGCTACTAACAATGCCATGCAAGTTGAATCTGATGATTACATAGCTACTAATGGACCACTT |
| AAAGTGGGTGGTAGTTGTGTTTTAAGCGGACACAATCTTGCTAAACACTGTCTTCATGTTGTCGGCCCAAATGTTAACAA |
| AGGTGAAGACATTCAACTTCTTAAGAGTGCTTATGAAAATTTTAATCAGCACGAAGTTCTACTTGCACCATTATTATCAG |
| CTGGTATTTTTGGTGCTGACCCTATACATTCTTTAAGAGTTTGTGTAGATACTGTTCGCACAAATGTCTACTTAGCTGTC |
| TTTGATAAAAATCTCTATGACAAACTTGTTTTAAGCTTTTTGGAAATGAAGAGTGAAAAGCAAGTTGAACAAAAGATCGC |
| TGAGATTCCTAAAGAGGAAGTTAAGCCATTTATAACTGAAAGTAAACCTTCAGTTGAACAGAGAAAACAAGATGATAAGA |
| AAATCAAAGCTTGTGTTGAAGAAGTTACAACAACTCTGGAAGAAACTAAGTTCCTCACAGAAAACTTGTTACTTTATATT |
| GACATTAATGGCAATCTTCATCCAGATTCTGCCACTCTTGTTAGTGACATTGACATCACTTTCTTAAAGAAAGATGCTCC |
| ATATATAGTGGGTGATGTTGTTCAAGAGGGTGTTTTAACTGCTGTGGTTATACCTACTAAAAAGGCTGGTGGCACTACTG |
| AAATGCTAGCGAAAGCTTTGAGAAAAGTGCCAACAGACAATTATATAACCACTTACCCGGGTCAGGGTTTAAATGGTTAC |
| ACTGTAGAGGAGGCAAAGACAGTGCTTAAAAAGTGTAAAAGTGCCTTTTACATTCTACCATCTATTATCTCTAATGAGAA |
| GCAAGAAATTCTTGGAACTGTTTCTTGGAATTTGCGAGAAATGCTTGCACATGCAGAAGAAACACGCAAATTAATGCCTG |
| TCTGTGTGGAAACTAAAGCCATAGTTTCAACTATACAGCGTAAATATAAGGGTATTAAAATACAAGAGGGTGTGGTTGAT |
| TATGGTGCTAGATTTTACTTTTACACCAGTAAAACAACTGTAGCGTCACTTATCAACACACTTAACGATCTAAATGAAAC |
| TCTTGTTACAATGCCACTTGGCTATGTAACACATGGCTTAAATTTGGAAGAAGCTGCTCGGTATATGAGATCTCTCAAAG |
| TGCCAGCTACAGTTTCTGTTTCTTCACCTGATGCTGTTACAGCGTATAATGGTTATCTTACTTCTTCTTCTAAAACACCT |
| GAAGAACATTTTATTGAAACCATCTCACTTGCTGGTTCCTATAAAGATTGGTCCTATTCTGGACAATCTACACAACTAGG |
| TATAGAATTTCTTAAGAGAGGTGATAAAAGTGTATATTACACTAGTAATCCTACCACATTCCACCTAGATGGTGAAGTTA |
| TCACCTTTGACAATCTTAAGCACTTCTTTCTTTGAGAGAAGTGAGGACTATTAAGGTGTTTACAACAGTAGACAACATT |
| AACCTCCACACGCAAGTTGTGGACATGTCAATGACATATGGACAACAGTTTGGTCCAACTTATTTGGATGGAGCTGATGT |
| TACTAAAATAAAACCTCATAATTCACATGAAGGTAAAACATTTTATGTTTTACCTAATGATGACACTCTACGTGTTGAGG |
| CTTTTGAGTACTACCACACAACTGATCCTAGTTTTCTGGGTAGGTACATGTCAGCATTAAATCACACTAAAAAGTGGAAA |
| TACCCACAAGTTAATGGTTTAACTTCTATTAAATGGGCAGATAACAACTGTTATCTTGCCACTGCATTGTTAACACTCCA |
| ACAAATAGAGTTGAAGTTTAATCCACCTGCTCTACAAGATGCTTATTACAGAGCAAGGGCTGGTGAAGCTGCTAACTTTT |
| GTGCACTTATCTTAGCCTACTGTAATAAGACAGTAGGTGAGTTAGGTGATGTTAGAGAAACAATGAGTTACTTGTTTCAA |
| CATGCCAATTTAGATTCTTGCAAAAGAGTCTTGAACGTGGTGTGTAAAACTTGTGGACAACAGCAGACAACCCTTAAGGG |
| TGTAGAAGCTGTTATGTACATGGGCACACTTTCTTATGAACAATTTAAGAAAGGTGTTCAGATACCTTGTACGTGTGGTA |
| AACAAGCTACACAATATCTAGTACAACAGGAGTCACCTTTTGTTATGATGTCAGCACCACCTGCTCAGTATGAACTTAAG |
| CATGGTACATTTACTTGTGCTAGTGAGTACACTGGTAATTACCAGTGTGGTCACTATAAACATATAACTTCTAAAGAAAC |
| TTTGTATTGCATAGACGGTGCTTTACTTACAAAGTCCTCAGAATACAAAGGTCCTATTACGGATGTTTTCTACAAAGAAA |
| ACAGTTACACAACAACCATAAAACCAGTTACTTATAAATTGGATGGTGTTGTTTGTACAGAAATTGACCCTAAGTTGGAC |
| AATTATTATAAGAAAGACAATTCTTATTTCACAGAGCAACCAATTGATCTTGTACCAAACCAACCATATCCAAACGCAAG |

SEQUENCES

```
CTTCGATAATTTTAAGTTTGTATGTGATAATATCAAATTTGCTGATGATTTAAACCAGTTAACTGGTTATAAGAAACCTG

CTTCAAGAGAGCTTAAAGTTACATTTTTCCCTGACTTAAATGGTGATGTGGTGGCTATTGATTATAAACACTACACACCC

TCTTTTAAGAAAGGAGCTAAATTGTTACATAAACCTATTGTTTGGCATGTTAACAATGCAACTAATAAAGCCACGTATAA

ACCAAATACCTGGTGTATACGTTGTCTTTGGAGCACAAAACCGGTTGAAACATCAAATTCGTTTGATGTACTGAAGTCAG

AGGACGCGCAGGGAATGGATAATCTTGCCTGCGAAGATCTAAAACCAGTCTCTGAAGAAGTAGTGGAAAATCCTACCATA

CAGAAAGACGTTCTTGAGTGTAATGTGAAAACTACCGAAGTTGTAGGAGACATTATACTTAAACCAGCAAATAATAGTTT

AAAAATTACAGAAGAGGTTGGCCACACAGATCTAATGGCTGCTTATGTAGACAATTCTAGTCTTACTATTAAGAAACCTA

ATGAATTATCTAGAGTGTTAGGTTTGAAAACCCTTGCTACTCATGGTTTAGCTGCTGTTAATAGTGTCCCTTGGGATACT

ATAGCTAATTATGCTAAGCCTTTTCTTAACAAAGTTGTTAGTACAACTACTAACATAGTTACACGGTGTTTAAACCGTGT

TTGTACTAATTATATGCCTTATTTCTTTACTTTATTGCTACAATTGTGTACTTTTACTAGAAGTACAAATTCTAGAATTA

AAGCATCTATGCCGACTACTATAGCAAAGAATACTGTTAAGAGTGTCGGTAAATTTTGTCTAGAGGCTTCATTTAATTAT

TTGAAGTCACCTAATTTTTCTAAACTGATAAATATTATAATTTGGTTTTTACTATTAAGTGTTTGCCTAGGTTCTTTAAT

CTACTCAACCGCTGCTTTAGGTGTTTTAATGTCTAATTTAGGCATGCCTTCTTACTGTACTGGTTACAGAGAAGGCTATT

TGAACTCTACTAATGTCACTATTGCAACCTACTGTACTGGTTCTATACCTTGTAGTGTTTGTCTTAGTGGTTTAGATTCT

TTAGACACCTATCCTTCTTTAGAAACTATACAAATTACCATTTCATCTTTTAAATGGGATTTAACTGCTTTTGGCTTAGT

TGCAGAGTGGTTTTTGGCATATATTCTTTTCACTAGGTTTTTCTATGTACTTGGATTGGCTGCAATCATGCAATTGTTTT

TCAGCTATTTTGCAGTACATTTTATTAGTAATTCTTGGCTTATGTGGTTAATAATTAATCTTGTACAAATGGCCCCGATT

TCAGCTATGGTTAGAATGTACATCTTCTTTGCATCATTTTATTATGTATGGAAAAGTTATGTGCATGTTGTAGACGGTTG

TAATTCATCAACTTGTATGATGTGTTACAAACGTAATAGAGCAACAAGAGTCGAATGTACAACTATTGTTAATGGTGTTA

GAAGGTCCTTTTATGTCTATGCTAATGGAGGTAAAGGCTTTTGCAAACTACACAATTGGAATTGTGTTAATTGTGATACA

TTCTGTGCTGGTAGTACATTTATTAGTGATGAAGTTGCGAGAGACTTGTCACTACAGTTTAAAAGACCAATAAATCCTAC

TGACCAGTCTTCTTACATCGTTGATAGTGTTACAGTGAAGAATGGTTCCATCCATCTTTACTTTGATAAAGCTGGTCAAA

AGACTTATGAAAGACATTCTCTCTCTCATTTTGTTAACTTAGACAACCTGAGAGCTAATAACACTAAAGGTTCATTGCCT

ATTAATGTTATAGTTTTTGATGGTAAATCAAAATGTGAAGAATCATCTGCAAAATCAGCGTCTGTTTACTACAGTCAGCT

TATGTGTCAACCTATACTGTTACTAGATCAGGCATTAGTGTCTGATGTTGGTGATAGTGCGGAAGTTGCAGTTAAAATGT

TTGATGCTTACGTTAATACGTTTTCATCAACTTTTAACGTACCAATGGAAAAACTCAAAACACTAGTTGCAACTGCAGAA

GCTGAACTTGCAAAGAATGTGTCCTTAGACAATGTCTTATCTACTTTTATTTCAGCAGCTCGGCAAGGGTTTGTTGATTC

AGATGTAGAAACTAAAGATGTTGTTGAATGTCTTAAATTGTCACATCAATCTGACATAGAAGTTACTGGCGATAGTTGTA

ATAACTATATGCTCACCTATAACAAAGTTGAAAACATGACACCCCGTGACCTTGGTGCTTGTATTGACTGTAGTGCGCGT

CATATTAATGCGCAGGTAGCAAAAAGTCACAACATTGCTTTGATATGGAACGTTAAAGATTTCATGTCATTGTCTGAACA

ACTACGAAAACAAATACGTAGTGCTGCTAAAAAGAATAACTTACCTTTTAAGTTGACATGTGCAACTACTAGACAAGTTG

TTAATGTTGTAACAACAAAGATAGCACTTAAGGGTGGTAAAATTGTTAATAATTGGTTGAAGCAGTTAATTAAAGTTACA

CTTGTGTTCCTTTTTGTTGCTGCTATTTTCTATTTAATAACACCTGTTCATGTCATGTCTAAACATACTGACTTTTCAAG

TGAAATCATAGGATACAAGGCTATTGATGGTGGTGTCACTCGTGACATAGCATCTACAGATACTTGTTTTGCTAACAAAC

ATGCTGATTTTGACACATGGTTTAGCCAGCGTGGTGGTAGTTATACTAATGACAAAGCTTGCCCATTGATTGCTGCAGTC

ATAACAAGAGAAGTGGGTTTTGTCGTGCCTGGTTTGCCTGGCACGATATTACGCACAACTAATGGTGACTTTTTGCATTT

CTTACCTAGAGTTTTTAGTGCAGTTGGTAACATCTGTTACACACCATCAAAACTTATAGAGTACACTGACTTTGCAACAT

CAGCTTGTGTTTTGGCTGCTGAATGTACAATTTTTAAAGATGCTTCTGGTAAGCCAGTACCATATTGTTATGATACCAAT
```

| SEQUENCES |
|---|
| GTACTAGAAGGTTCTGTTGCTTATGAAAATTTACGCCCTGACACACGTTATGTGCTCATGGATGGCTCTATTATTCAATT |
| TCCTAACACCTACCTTGAAGGTTCTGTTAGAGTGGTAACAACTTTTGATTCTGAGTACTGTAGGCACGGCACTTGTGAAA |
| GATCAGAAGCTGGTGTTTGTGTATCTACTAGTGGTAGATGGGTACTTAACAATGATTATTACAGATCTTTACCAGGAGTT |
| TTCTGTGGTGTAGATGCTGTAAATTTACTTACTAATATGTTTACACCACTAATTCAACCTATTGGTGCTTTGGACATATC |
| AGCATCTATAGTAGCTGGTGGTATTGTAGCTATCGTAGTAACATGCCTTGCCTACTATTTTATGAGGTTTAGAAGAGCTT |
| TTGGTGAATACAGTCATGTAGTTGCCTTTAATACTTTACTATTCCTTATGTCATTCACTGTACTCTGTTTAACACCAGTT |
| TACTCATTCTTACCTGGTGTTTATTCTGTTATTTACTTGTACTTGACATTTTATCTTACTAATGATGTTTCTTTTTTAGC |
| ACATATTCAGTGGATGGTTATGTTCACACCTTTAGTACCTTTCTGGATAACAATTGCTTATATCATTTGTATTTCCACAA |
| AGCATTTCTATTGGTTCTTTAGTAATTACCTAAAGAGACGTGTAGTCTTTAATGGTGTTTCCTTTAGTACTTTTGAAGAA |
| GCTGCGCTGTGCACCTTTTTGTTAAATAAAGAAATGTATCTAAAGTTGCGTAGTGATGTGCTATTACCTCTTACGCAATA |
| TAATAGATACTTAGCTCTTTATAATAAGTACAAGTATTTTAGTGGAGCAATGGATACAACTAGCTACAGAGAAGCTGCTT |
| GTTGTCATCTCGCAAAGGCTCTCAATGACTTCAGTAACTCAGGTTCTGATGTTCTTTACCAACCACCACAAACCTCTATC |
| ACCTCAGCTGTTTTGCAGAGTGGTTTTAGAAAAATGGCATTCCCATCTGGTAAAGTTGAGGGTTGTATGGTACAAGTAAC |
| TTGTGGTACAACTACACTTAACGGTCTTTGGCTTGATGACGTAGTTTACTGTCCAAGACATGTGATCTGCACCTCTGAAG |
| ACATGCTTAACCCTAATTATGAAGATTACTCATTCGTAAGTCTAATCATAATTTCTTGGTACAGGCTGGTAATGTTCAA |
| CTCAGGGTTATTGGACATTCTATGCAAATTGTGTACTTAAGCTTAAGGTTGATACAGCCAATCCTAAGACACCTAAGTA |
| TAAGTTTGTTCGCATTCAACCAGGACAGACTTTTTCAGTGTTAGCTTGTTACAATGGTTCACCATCTGGTGTTTACCAAT |
| GTGCTATGAGGCCCAATTTCACTATTAAGGGTTCATTCCTTAATGGTTCATGTGGTAGTGTTGGTTTTAACATAGATTAT |
| GACTGTGTCTCTTTTTGTTACATGCACCATATGGAATTACCAACTGGAGTTCATGCTGGCACAGACTTAGAAGGTAACTT |
| TTATGGACCTTTTGTTGACAGGCAAACAGCACAAGCAGCTGGTACGGACACAACTATTACAGTTAATGTTTTAGCTTGGT |
| TGTACGCTGCTGTTATAAATGGAGACAGGTGGTTTCTCAATCGATTTACCACAACTCTTAATGACTTTAACCTTGTGGCT |
| ATGAAGTACAATTATGAACCTCTAACACAAGACCATGTTGACATACTAGGACCTCTTTCTGCTCAAACTGGAATTGTCGT |
| TTTAGATATGTGTGCTTCATTAAAAGAATTACTGCAAAATGGTATGAATGGACGTACCATATTGGGTAGTGCTTTATTAG |
| AAGATGAATTTACACCTTTTGATGTTGTTAGACAATGCTCAGGTGTTACTTTCCAAAGTGCAGTGAAAAGAACAATCAAG |
| GGTACACACCACTGGTTGTTACTCACAATTTTGACTTCACTTTTAGTTTTAGTCCAGAGTACTCAATGGTCTTTGTTCTT |
| TTTTTTGTATGAAAATGCCTTTTTACCTTTTGCTATGGGTATTATTGCTATGTCTGCTTTTGCAATGATGTTTGTCAAAC |
| ATAAGCATGCATTTCTCTGTTTGTTTTTGTTACCTTCTCTTGCCACTGTAGCTTATTTTAATATGGTCTATATGCCTGCT |
| AGTTGGGTGATGCGTATTATGACATGGTTGGATATGGTTGATACTAGTTTGAAGCTAAAAGACTGTGTTATGTATGCATC |
| AGCTGTAGTGTTACTAATCCTTATGACAGCAAGAACTGTGTATGATGATGGTGCTAGGAGAGTGTGGACACTTATGAATG |
| TCTTGACACTCGTTTATAAAGTTTATTATGGTAATGCTTTAGATCAAGCCATTTCCATGTGGGCTCTTATAATCTCTGTT |
| ACTTCTAACTACTCAGGTGTAGTTACAACTGTCATGTTTTTGGCCAGAGGTATTGTTTTATGTGTGTTGAGTATTGCCC |
| TATTTTCTTCATAACTGGTAATACACTTCAGTGTATAATGCTAGTTTATTGTTTCTTAGGCTATTTTTGTACTTGTTACT |
| TTGGCCTCTTTTGTTTACTCAACCGCTACTTTAGACTGACTCTTGGTGTTTATGATTACTTAGTTTCTACACAGGAGTTT |
| AGATATATGAATTCACAGGGACTACTCCCACCCAAGAATAGCATAGATGCCTTCAAACTCAACATTAAATTGTTGGGTGT |
| TGGTGGCAAACCTTGTATCAAAGTAGCCACTGTACAGTCTAAAATGTCAGATGTAAAGTGCACATCAGTAGTCTTACTCT |
| CAGTTTTGCAACAACTCAGAGTAGAATCATCATCTAAATTGTGGGCTCAATGTGTCCAGTTACACAATGACATTCTCTTA |
| GCTAAAGATACTACTGAAGCCTTTGAAAAAATGGTTTCACTACTTTCTGTTTTGCTTTCCATGCAGGGTGCTGTAGACAT |
| AAACAAGCTTTGTGAAGAAATGCTGGACAACAGGGCAACCTTACAAGCTATAGCCTCAGAGTTTAGTTCCCTTCCATCAT |
| ATGCAGCTTTTGCTACTGCTCAAGAAGCTTATGAGCAGGCTGTTGCTAATGGTGATTCTGAAGTTGTTCTTAAAAAGTTG |

SEQUENCES

```
AAGAAGTCTTTGAATGTGGCTAAATCTGAATTTGACCGTGATGCAGCCATGCAACGTAAGTTGGAAAAGATGGCTGATCA
AGCTATGACCCAAATGTATAAACAGGCTAGATCTGAGGACAAGAGGGCAAAAGTTACTAGTGCTATGCAGACAATGCTTT
TCACTATGCTTAGAAAGTTGGATAATGATGCACTCAACAACATTATCAACAATGCAAGAGATGGTTGTGTTCCCTTGAAC
ATAATACCTCTTACAACAGCAGCCAAACTAATGGTTGTCATACCAGACTATAACACATATAAAAATACGTGTGATGGTAC
AACATTTACTTATGCATCAGCATTGTGGGAAATCCAACAGGTTGTAGATGCAGATAGTAAAATTGTTCAACTTAGTGAAA
TTAGTATGGACAATTCACCTAATTTAGCATGGCCTCTTATTGTAACAGCTTTAAGGGCCAATTCTGCTGTCAAATTACAG
AATAATGAGCTTAGTCCTGTTGCACTACGACAGATGTCTTGTGCTGCCGGTACTACACAAACTGCTTGCACTGATGACAA
TGCGTTAGCTTATTACAACACAACAAAGGGAGGTAGGTTTGTACTTGCACTGTTATCCGATTTACAGGATTTGAAATGGG
CTAGATTCCCTAAGAGTGATGGAACTGGTACTATCTATACAGAACTGGAACCACCTTGTAGGTTTGTTACAGACACACCT
AAAGGTCCTAAAGTGAAGTATTTATACTTTATTAAAGGATTAAACAACCTAAATAGAGGTATGGTACTTGGTAGTTTAGC
TGCCACAGTACGTCTACAAGCTGGTAATGCAACAGAAGTGCCTGCCAATTCAACTGTATTATCTTTCTGTGCTTTTGCTG
TAGATGCTGCTAAAGCTTACAAAGATTATCTAGCTAGTGGGGACAACCAATCACTAATTGTGTTAAGATGTTGTGTACA
CACACTGGTACTGGTCAGGCAATAACAGTTACACCGGAAGCCAATATGGATCAAGAATCCTTTGGTGGTGCATCGTGTTG
TCTGTACTGCCGTTGCCACATAGATCATCCAAATCCTAAAGGATTTTGTGACTTAAAAGGTAAGTATGTACAAATACCTA
CAACTTGTGCTAATGACCCTGTGGGTTTTACACTTAAAAACACAGTCTGTACCGTCTGCGGTATGTGGAAAGGTTATGGC
TGTAGTTGTGATCAACTCCGCGAACCCATGCTTCAGTCAGCTGATGCACAATCGTTTTTAAACGGGTTTGCGGTGTAAGT
GCAGCCCGTCTTACACCGTGCGGCACAGGCACTAGTACTGATGTCGTATACAGGGCTTTTGACATCTACAATGATAAAGT
AGCTGGTTTTGCTAAATTCCTAAAAACTAATTGTTGTCGCTTCCAAGAAAAGGACGAAGATGACAATTTAATTGATTCTT
ACTTTGTAGTTAAGAGACACACTTTCTCTAACTACCAACATGAAGAAACAATTTATAATTTACTTAAGGATTGTCCAGCT
GTTGCTAAACATGACTTCTTTAAGTTTAGAATAGACGGTGACATGGTACCACATATATCACGTCAACGTCTTACTAAATA
CACAATGGCAGACCTCGTCTATGCTTTAAGGCATTTTGATGAAGGTAATTGTGATACATTAAAAGAAATACTTGTCACAT
ACAATTGTTGTGATGATGATTATTTCAATAAAAAGGACTGGTATGATTTTGTAGAAAACCCAGATATATTACGCGTATAC
GCCAACTTAGGTGAACGTGTACGCCAAGCTTTGTTAAAAACAGTACAATTCTGTGATGCCATGCGAAATGCTGGTATTGT
TGGTGTACTGACATTAGATAATCAAGATCTCAATGGTAACTGGTATGATTTCGGTGATTTCATACAAACCACGCCAGGTA
GTGGAGTTCCTGTTGTAGATTCTTATTATTCATTGTTAATGCCTATATTAACCTTGACCAGGGCTTTAACTGCAGAGTCA
CATGTTGACACTGACTTAACAAAGCCTTACATTAAGTGGGATTTGTTAAAATATGACTTCACGGAAGAGAGGTTAAAACT
CTTTGACCGTTATTTTAAATATTGGGATCAGACATACCACCCAAATTGTGTTAACTGTTTGGATGACAGATGCATTCTGC
ATTGTGCAAACTTTAATGTTTTATTCTCTACAGTGTTCCCACTTACAAGTTTTGGACCACTAGTGAGAAAAATATTTGTT
GATGGTGTTCCATTTGTAGTTTCAACTGGATACCACTTCAGAGAGCTAGGTGTTGTACATAATCAGGATGTAAACTTACA
TAGCTCTAGACTTAGTTTTAAGGAATTACTTGTGTATGCTGCTGACCCTGCTATGCACGCTGCTTCTGGTAATCTATTAC
TAGATAAACGCACTACGTGCTTTTCAGTAGCTGCACTTACTAACAATGTTGCTTTTCAAACTGTCAAACCCGGTAATTTT
AACAAAGACTTCTATGACTTTGCTGTGTCTAAGGGTTTCTTTAAGGAAGGAAGTTCTGTTGAATTAAAACACTTCTTCTT
TGCTCAGGATGGTAATGCTGCTATCAGCGATTATGACTACTATCGTTATAATCTACCAACAATGTGTGATATCAGACAAC
TACTATTTGTAGTTGAAGTTGTTGATAAGTACTTTGATTGTTACGATGGTGGCTGTATTAATGCTAACCAAGTCATCGTC
AACAACCTAGACAAATCAGCTGGTTTTCCATTTAATAAATGGGGTAAGGCTAGACTTTATTATGATTCAATGAGTTATGA
GGATCAAGATGCACTTTTCGCATATACAAAACGTAATGTCATCCCTACTATAACTCAAATGAATCTTAAGTATGCCATTA
GTGCAAAGAATAGAGCTCGCACCGTAGCTGGTGTCTCTATCTGTAGTACTATGACCAATAGACAGTTTCATCAAAAATTA
TTGAAATCAATAGCCGCCACTAGAGGAGCTACTGTAGTAATTGGAACAAGCAAATTCTATGGTGGTTGGCACAACATGTT
```

| SEQUENCES |
|---|
| AAAAACTGTTTATAGTGATGTAGAAAACCCTCACCTTATGGGTTGGGATTATCCTAAATGTGATAGAGCCATGCCTAACA |
| TGCTTAGAATTATGGCCTCACTTGTTCTTGCTCGCAAACATACAACGTGTTGTAGCTTGTCACACCGTTTCTATAGATTA |
| GCTAATGAGTGTGCTCAAGTATTGAGTGAAATGGTCATGTGTGGCGGTTCACTATATGTTAAACCAGGTGGAACCTCATC |
| AGGAGATGCCACAACTGCTTATGCTAATAGTGTTTTTAACATTTGTCAAGCTGTCACGGCCAATGTTAATGCACTTTTAT |
| CTACTGATGGTAACAAAATTGCCGATAAGTATGTCCGCAATTTACAACACAGACTTTATGAGTGTCTCTATAGAAATAGA |
| GATGTTGACACAGACTTTGTGAATGAGTTTTACGCATATTTGCGTAAACATTTCTCAATGATGATACTCTCTGACGATGC |
| TGTTGTGTGTTTCAATAGCACTTATGCATCTCAAGGTCTAGTGGCTAGCATAAAGAACTTTAAGTCAGTTCTTTATTATC |
| AAAACAATGTTTTTATGTCTGAAGCAAAATGTTGGACTGAGACTGACCTTACTAAAGGACCTCATGAATTTTGCTCTCAA |
| CATACAATGCTAGTTAAACAGGGTGATGATTATGTGTACCTTCCTTACCCAGATCCATCAAGAATCCTAGGGGCCGGCTG |
| TTTTGTAGATGATATCGTAAAAACAGATGGTACACTTATGATTGAACGGTTCGTGTCTTTAGCTATAGATGCTTACCCAC |
| TTACTAAACATCCTAATCAGGAGTATGCTGATGTCTTTCATTTGTACTTACAATACATAAGAAAGCTACATGATGAGTTA |
| ACAGGACACATGTTAGACATGTATTCTGTTATGCTTACTAATGATAACACTTCAAGGTATTGGGAACCTGAGTTTTATGA |
| GGCTATGTACACACCGCATACAGTCTTACAGGCTGTTGGGGCTTGTGTTCTTTGCAATTCACAGACTTCATTAAGATGTG |
| GTGCTTGCATACGTAGACCATTCTTATGTTGTAAATGCTGTTACGACCATGTCATATCAACATCACATAAATTAGTCTTG |
| TCTGTTAATCCGTATGTTTGCAATGCTCCAGGTTGTGATGTCACAGATGTGACTCAACTTTACTTAGGAGGTATGAGCTA |
| TTATTGTAAATCACATAAACCACCCATTAGTTTTCCATTGTGTGCTAATGGACAAGTTTTTGGTTTATATAAAAATACAT |
| GTGTTGGTAGCGATAATGTTACTGACTTTAATGCAATTGCAACATGTGACTGGACAAATGCTGGTGATTACATTTTAGCT |
| AACACCTGTACTGAAAGACTCAAGCTTTTTGCAGCAGAAACGCTCAAAGCTACTGAGGAGACATTTAAACTGTCTTATGG |
| TATTGCTACTGTACGTGAAGTGCTGTCTGACAGAGAATTACATCTTTCATGGGAAGTTGGTAAACCTAGACCACCACTTA |
| ACCGAAATTATGTCTTTACTGGTTATCGTGTAACTAAAAACAGTAAAGTACAAATAGGAGAGTACACCTTTGAAAAAGGT |
| GACTATGGTGATGCTGTTGTTTACCGAGGTACAACAACTTACAAATTAAATGTTGGTGATTATTTTGTGCTGACATCACA |
| TACAGTAATGCCATTAAGTGCACCTACACTAGTGCCACAAGAGCACTATGTTAGAATTACTGGCTTATACCCAACACTCA |
| ATATCTCAGATGAGTTTTCTAGCAATGTTGCAAATTATCAAAAGGTTGGTATGCAAAAGTATTCTACACTCCAGGGACCA |
| CCTGGTACTGGTAAGAGTCATTTTGCTATTGGCCTAGCTCTCTACTACCCTTCTGCTCGCATAGTGTATACAGCTTGCTC |
| TCATGCCGCTGTTGATGCACTATGTGAGAAGGCATTAAAATATTTGCCTATAGATAAATGTAGTAGAATTATACCTGCAC |
| GTGCTCGTGTAGATTGTTTTGATAAATTCAAAGTGAATTCAACATTAGAACAGTATGTCTTTTGTACTGTAAATGCATTG |
| CCTGAGACGACAGCAGATATAGTTGTCTTTGATGAAATTTCAATGGCCACAAATTATGATTTGAGTGTTGTCAATGCCAG |
| ATTACGTGCTAAGCACTATGTGTACATTGGCGACCCTGCTCAATTACCTGCACCACGCACATTGCTAACTAAGGGCACAC |
| TAGAACCAGAATATTTCAATTCAGTGTGTAGACTTATGAAAACTATAGGTCCAGACATGTTCCTCGGAACTTGTCGGCGT |
| TGTCCTGCTGAAATTGTTGACACTGTGAGTGCTTTGGTTTATGATAATAAGCTTAAAGCACATAAAGACAAATCAGCTCA |
| ATGCTTTAAAATGTTTTATAAGGGTGTTATCACGCATGATGTTTCATCTGCAATTAACAGGCCACAAATAGGCGTGGTAA |
| GAGAATTCCTTACACGTAACCCTGCTTGGAGAAAAGCTGTCTTTATTTCACCTTATAATTCACAGAATGCTGTAGCCTCA |
| AAGATTTTGGGACTACCAACTCAAACTGTTGATTCATCACAGGGCTCAGAATATGACTATGTCATATTCACTCAAACCAC |
| TGAAACAGCTCACTCTTGTAATGTAAACAGATTTAATGTTGCTATTACCAGAGCAAAAGTAGGCATACTTTGCATAATGT |
| CTGATAGAGACCTTTATGACAAGTTGCAATTTACAAGTCTTGAAATTCCACGTAGGAATGTGGCAACTTTACAAGCTGAA |
| AATGTAACAGGACTCTTTAAAGATTGTAGTAAGGTAATCACTGGGTTACATCCTACACAGGCACCTACACACCTCAGTGT |
| TGACACTAAATTCAAAACTGAAGGTTTATGTGTTGACATACCTGGCATACCTAAGGACATGACCTATAGAAGACTCATCT |
| CTATGATGGGTTTTAAAATGAATTATCAAGTTAATGGTTACCCTAACATGTTTATCACCCGCGAAGAAGCTATAAGACAT |
| GTACGTGCATGGATTGGCTTCGATGTCGAGGGGTGTCATGCTACTAGAGAAGCTGTTGGTACCAATTTACCTTTACAGCT |

```
AGGTTTTTCTACAGGTGTTAACCTAGTTGCTGTACCTACAGGTTATGTTGATACACCTAATAATACAGATTTTTCCAGAG

TTAGTGCTAAACCACCGCCTGGAGATCAATTTAAACACCTCATACCACTTATGTACAAAGGACTTCCTTGGAATGTAGTG

CGTATAAAGATTGTACAAATGTTAAGTGACACACTTAAAAATCTCTCTGACAGAGTCGTATTTGTCTTATGGGCACATGG

CTTTGAGTTGACATCTATGAAGTATTTTGTGAAAATAGGACCTGAGCGCACCTGTTGTCTATGTGATAGACGTGCCACAT

GCTTTTCCACTGCTTCAGACACTTATGCCTGTTGGCATCATTCTATTGGATTTGATTACGTCTATAATCCGTTTATGATT

GATGTTCAACAATGGGTTTTACAGGTAACCTACAAAGCAACCATGATCTGTATTGTCAAGTCCATGGTAATGCACATGT

AGCTAGTTGTGATGCAATCATGACTAGGTGTCTAGCTGTCCACGAGTGCTTTGTTAAGCGTGTTGACTGGACTATTGAAT

ATCCTATAATTGGTGATGAACTGAAGATTAATGCGGCTTGTAGAAAGGTTCAACACATGGTTGTTAAAGCTGCATTATTA

GCAGACAAATTCCCAGTTCTTCACGACATTGGTAACCCTAAAGCTATTAAGTGTGTACCTCAAGCTGATGTAGAATGGAA

GTTCTATGATGCACAGCCTTGTAGTGACAAAGCTTATAAAATAGAAGAATTATTCTATTCTTATGCCACACATTCTGACA

AATTCACAGATGGTGTATGCCTATTTTGGAATTGCAATGTCGATAGATATCCTGCTAATTCCATTGTTTGTAGATTTGAC

ACTAGAGTGCTATCTAACCTTAACTTGCCTGGTTGTGATGGTGGCAGTTTGTATGTAAATAAACATGCATTCCACACACC

AGCTTTTGATAAAAGTGCTTTTGTTAATTTAAAACAATTACCATTTTTCTATTACTCTGACAGTCCATGTGAGTCTCATG

GAAAACAAGTAGTGTCAGATATAGATTATGTACCACTAAAGTCTGCTACGTGTATAACACGTTGCAATTTAGGTGGTGCT

GTCTGTAGACATCATGCTAATGAGTACAGATTGTATCTCGATGCTTATAACATGATGATCTCAGCTGGCTTTAGCTTGTG

GGTTTACAAACAATTTGATACTTATAACCTCTGGAACACTTTTACAAGACTTCAGAGTTTAGAAAATGTGGCTTTTAATG

TTGTAAATAAGGGACACTTTGATGGACAACAGGGTGAAGTACCAGTTTCTATCATTAATAACACTGTTTACACAAAAGTT

GATGGTGTTGATGTAGAATTGTTTGAAAATAAAACAACATTACCTGTTAATGTAGCATTTGAGCTTTGGGCTAAGCGCAA

CATTAAACCAGTACCAGAGGTGAAAATACTCAATAATTTGGGTGTGGACATTGCTGCTAATACTGTGATCTGGGACTACA

AAAGAGATGCTCCAGCACATATATCTACTATTGGTGTTTGTTCTATGACTGACATAGCCAAGAAACCAACTGAAACGATT

TGTGCACCACTCACTGTCTTTTTTGATGGTAGAGTTGATGGTCAAGTAGACTTATTTAGAAATGCCCGTAATGGTGTTCT

TATTACAGAAGGTAGTGTTAAAGGTTTACAACCATCTGTAGGTCCCAAACAAGCTAGTCTTAATGGAGTCACATTAATTG

GAGAAGCCGTAAAAACACAGTTCAATTATTATAAGAAAGTTGATGGTGTTGTCCAACAATTACCTGAAACTTACTTTACT

CAGAGTAGAAATTTACAAGAATTTAAACCCAGGAGTCAAATGGAAATTGATTTCTTAGAATTAGCTATGGATGAATTCAT

TGAACGGTATAAATTAGAAGGCTATGCCTTCGAACATATCGTTTATGGAGATTTTAGTCATAGTCAGTTAGGTGGTTTAC

ATCTACTGATTGGACTAGCTAAACGTTTTAAGGAATCACCTTTTGAATTAGAAGATTTTATTCCTATGGACAGTACAGTT

AAAAACTATTTCATAACAGATGCGCAAACAGGTTCATCTAAGTGTGTGTGTTCTGTTATTGATTTATTACTTGATGATTT

TGTTGAAATAATAAAATCCCAAGATTTATCTGTAGTTTCTAAGGTTGTCAAAGTGACTATTGACTATACAGAAATTTCAT

TTATGCTTTGGTGTAAAGATGGCCATGTAGAAACATTTTACCCAAAATTACAATCTAGTCAAGCGTGGCAACCGGGTGTT

GCTATGCCTAATCTTTACAAAATGCAAAGAATGCTATTAGAAAAGTGTGACCTTCAAAATTATGGTGATAGTGCAACATT

ACCTAAAGGCATAATGATGAATGTCGCAAAATATACTCAACTGTGTCAATATTTAAACACATTAACATTAGCTGTACCCT

ATAATATGAGAGTTATACATTTTGGTGCTGGTTCTGATAAAGGAGTTGCACCAGGTACAGCTGTTTTAAGACAGTGGTTG

CCTACGGGTACGCTGCTTGTCGATTCAGATCTTAATGACTTTGTCTCTGATGCAGATTCAACTTTGATTGGTGATTGTGC

AACTGTACATACAGCTAATAAATGGGATCTCATTATTAGTGATATGTACGACCCTAAGACTAAAAATGTTACAAAAGAAA

ATGACTCTAAAGAGGGTTTTTTCACTTACATTTGTGGGTTTATACAACAAAAGCTAGCTCTTGGAGGTTCCGTGGCTATA

AAGATAACAGAACATTCTTGGAATGCTGATCTTTATAAGCTCATGGGACACTTCGCATGGTGGACAGCCTTTGTTACTAA

TGTGAATGCGTCATCATCTGAAGCATTTTTAATTGGATGTAATTATCTTGGCAAACCACGCGAACAAATAGATGGTTATG

TCATGCATGCAAATTACATATTTTGGAGGAATACAAATCCAATTCAGTTGTCTTCCTATTCTTTATTTGACATGAGTAAA
```

| SEQUENCES |
|---|
| TTTCCCCTTAAATTAAGGGGTACTGCTGTTATGTCTTTAAAAGAAGGTCAAATCAATGATATGATTTTATCTCTTCTTAG |
| TAAAGGTAGACTTATAATTAGAGAAAACAACAGAGTTGTTATTTCTAGTGATGTTCTTGTTAACAACTAAACGAACAATG |
| TTTGTTTTTCTTGTTTTATTGCCACTAGTCTCTAGTCAGTGTGTTAATTTTACAAACAGAACTCAATTACCCTCTGCATA |
| CACTAATTCTTTCACACGTGGTGTTTATTACCCTGACAAAGTTTTCAGATCCTCAGTTTTACATTCAACTCAGGACTTGT |
| TCTTACCTTTCTTTTCCAATGTTACTTGGTTCCATGCTATACATGTCTCTGGGACCAATGGTACTAAGAGGTTTGATAAC |
| CCTGTCCTACCATTTAATGATGGTGTTTATTTTGCTTCCACTGAGAAGTCTAACATAATAAGAGGCTGGATTTTGGTAC |
| TACTTTAGATTCGAAGACCCAGTCCCTACTTATTGTTAATAACGCTACTAATGTTGTTATTAAAGTCTGTGAATTTCAAT |
| TTTGTAATTATCCATTTTTGGGTGTTTATTACCACAAAAACAACAAAAGTTGGATGGAAAGTGAGTTCAGAGTTTATTCT |
| AGTGCGAATAATTGCACTTTTGAATATGTCTCTCAGCCTTTTCTTATGGACCTTGAAGGAAAACAGGGTAATTTCAAAAA |
| TCTTAGTGAATTTGTGTTTAAGAATATTGATGGTTATTTTAAAATATATTCTAAGCACACGCCTATTAATTTAGTGCGTG |
| ATCTCCCTCAGGGTTTTTCGGCTTTAGAACCATTGGTAGATTTGCCAATAGGTATTAACATCACTAGGTTTCAAACTTTA |
| CTTGCTTTACATAGAAGTTATTTGACTCCTGGTGATTCTTCTTCAGGTTGGACAGCTGGTGCTGCAGCTTATTATGTGGG |
| TTATCTTCAACCTAGGACTTTTCTATTAAAATATAATGAAAATGGAACCATTACAGATGCTGTAGACTGTGCACTTGACC |
| CTCTCTCAGAAACAAAGTGTACGTTGAAATCCTTCACTGTAGAAAAAGGAATCTATCAAACTTCTAACTTTAGAGTCCAA |
| CCAACAGAATCTATTGTTAGATTTCCTAATATTACAAACTTGTGCCCTTTTGGTGAAGTTTTTAACGCCACCAGATTTGC |
| ATCTGTTTATGCTTGGAACAGGAAGAGAATCAGCAACTGTGTTGCTGATTATTCTGTCCTATATAATTCCGCATCATTTT |
| CCACTTTTAAGTGTTATGGAGTGTCTCCTACTAAATTAAATGATCTCTGCTTTACTAATGTCTATGCAGATTCATTTGTA |
| ATTAGAGGTGATGAAGTCAGACAAATCGCTCCAGGGCAAACTGGAACGATTGCTGATTATAATTATAAATTACCAGATGA |
| TTTTACAGGCTGCGTTATAGCTTGGAATTCTAACAATCTTGATTCTAAGGTTGGTGGTAATTATAATTACCTGTATAGAT |
| TGTTTAGGAAGTCTAATCTCAAACCTTTTGAGAGAGATATTTCAACTGAAATCTATCAGGCCGGTAGCACACCTTGTAAT |
| GGTGTTAAAGGTTTTAATTGTTACTTTCCTTTACAATCATATGGTTTCCAACCCACTTATGGTGTTGGTTACCAACCATA |
| CAGAGTAGTAGTACTTTCTTTTGAACTTCTACATGCACCAGCAACTGTTTGTGGACCTAAAAAGTCTACTAATTTGGTTA |
| AAAACAAATGTGTCAATTTCAACTTCAATGGTTTAACAGGCACAGGTGTTCTTACTGAGTCTAACAAAAAGTTTCTGCCT |
| TTCCAACAATTTGGCAGAGACATTGCTGACACTACTGATGCTGTCCGTGATCCACAGACACTTGAGATTCTTGACATTAC |
| ACCATGTTCTTTTGGTGGTGTCAGTGTTATAACACCAGGAACAAATACTTCTAATCAGGTTGCTGTTCTTTATCAGGGTG |
| TTAACTGCACAGAAGTCCCTGTTGCTATTCATGCAGATCAACTTACTCCTACTTGGCGTGTTTATTCTACAGGTTCTAAT |
| GTTTTTCAAACACGTGCAGGCTGTTTAATAGGGGCTGAATATGTCAACAACTCATATGAGTGTGACATACCCATTGGTGC |
| AGGTATATGCGCTAGTTATCAGACTCAGACTAATTCTCCTCGGCGGGCACGTAGTGTAGCTAGTCAATCCATCATTGCCT |
| ACACTATGTCACTTGGTGCAGAAAATTCAGTTGCTTACTCTAATAACTCTATTGCCATACCCACAAATTTTACTATTAGT |
| GTTACCACAGAAATTCTACCAGTGTCTATGACCAAGACATCAGTAGATTGTACAATGTACATTTGTGGTGATTCAACTGA |
| ATGCAGCAATCTTTTGTTGCAATATGGCAGTTTTTGTACACAATTAAACCGTGCTTTAACTGGAATAGCTGTTGAACAAG |
| ACAAAAACACCCAAGAAGTTTTTGCACAAGTCAAACAAATTTACAAAACACCACCAATTAAAGATTTTGGTGGTTTTAAT |
| TTTTCACAAATATTACCAGATCCATCAAAACCAAGCAAGAGGTCATTTATTGAAGATCTACTTTTCAACAAAGTGACACT |
| TGCAGATGCTGGCTTCATCAAACAATATGGTGATTGCCTTGGTGATATTGCTGCTAGAGACCTCATTTGTGCACAAAAGT |
| TTAACGGCCTTACTGTTTTGCCACCTTTGCTCACAGATGAAATGATTGCTCAATACACTTCTGCACTGTTAGCGGGTACA |
| ATCACTTCTGGTTGGACCTTTGGTGCAGGTGCTGCATTACAAATACCATTTGCTATGCAAATGGCTTATAGGTTTAATGG |
| TATTGGAGTTACACAGAATGTTCTCTATGAGAACCAAAAATTGATTGCCAACCAATTTAATAGTGCTATTGGCAAAATTC |
| AAGACTCACTTTCTTCCACAGCAAGTGCACTTGGAAAACTTCAAGATGTGGTCAACCAAAATGCACAAGCTTTAAACACG |
| CTTGTTAAACAACTTAGCTCCAATTTTGGTGCAATTTCAAGTGTTTTAAATGATATCCTTTCACGTCTTGACAAAGTTGA |

-continued

| SEQUENCES |
|---|
| GGCTGAAGTGCAAATTGATAGGTTGATCACAGGCAGACTTCAAAGTTTGCAGACATATGTGACTCAACAATTAATTAGAG |
| CTGCAGAAATCAGAGCTTCTGCTAATCTTGCTGCTATTAAAATGTCAGAGTGTGTACTTGGACAATCAAAAAGAGTTGAT |
| TTTTGTGGAAAGGGCTATCATCTTATGTCCTTCCCTCAGTCAGCACCTCATGGTGTAGTCTTCTTGCATGTGACTTATGT |
| CCCTGCACAAGAAAAGAACTTCACAACTGCTCCTGCCATTTGTCATGATGGAAAAGCACACTTTCCTCGTGAAGGTGTCT |
| TTGTTTCAAATGGCACACACTGGTTTGTAACACAAAGGAATTTTTATGAACCACAAATCATTACTACAGACAACACATTT |
| GTGTCTGGTAACTGTGATGTTGTAATAGGAATTGTCAACAACACAGTTTATGATCCTTTGCAACCTGAATTAGACTCATT |
| CAAGGAGGAGTTAGATAAATATTTTAAGAATCATACATCACCAGATGTTGATTTAGGTGACATCTCTGGCATTAATGCTT |
| CATTTGTAAACATTCAAAAAGAAATTGACCGCCTCAATGAGGTTGCCAAGAATTTAAATGAATCTCTCATCGATCTCCAA |
| GAACTTGGAAAGTATGAGCAGTATATAAAATGGCCATGGTACATTTGGCTAGGTTTTATAGCTGGCTTGATTGCCATAGT |
| AATGGTGACAATTATGCTTTGCTGTATGACCAGTTGCTGTAGTTGTCTCAAGGGCTGTTGTTCTTGTGGATCCTGCTGCA |
| AATTTGATGAAGACGACTCTGAGCCAGTGCTCAAAGGAGTCAAATTACATTACACATAAACGAACTTATGGATTTGTTTA |
| TGAGAATCTTCACAATTGGAACTGTAACTTTGAAGCAAGGTGAAATCAAGGATGCTACTCCTTCAGATTTTGTTCGCGCT |
| ACTGCAACGATACCGATACAAGCCTCACTCCCTTTCGGATGGCTTATTGTTGGCGTTGCACTTCTTGCTGTTTTTCAGAG |
| CGCTTCCAAAATCATAACCCTCAAAAAGAGATGGCAACTAGCACTCTCCAAGGGTGTTCACTTTGTTTGCAACTTGCTGT |
| TGTTGTTGTAACAGTTTACTCACACCTTTTGCTCGTTGCTGCTGGCCTTGAAGCCCCTTTTCTCTATCTTTATGCTTTA |
| GTCTACTTCTTGCAGAGTATAAACTTTGTAAGAATAATAATGAGGCTTTGGCTTTGCTGGAAATGCCGTTCCAAAAACCC |
| ATTACTTTATGATGCCAACTATTTTCTTTGCTGGCATACTAATTGTTACGACTATTGTATACCTTACAATAGTGTAACTT |
| CTTCAATTGTCATTACTTCAGGTGATGGCACAACAAGTCCTATTTCTGAACATGACTACCAGATTGGTGGTTATACTGAA |
| AAATGGGAATCTGGAGTAAAAGACTGTGTTGTATTACACAGTTACTTCACTTCAGACTATTACCAGCTGTACTCAACTCA |
| ATTGAGTACAGACACTGGTGTTGAACATGTTACCTTCTTCATCTACAATAAAATTGTTGATGAGCCTGAAGAACATGTCC |
| AAATTCACACAATCGACGGTTCACCCGGAGTTGTTAATCCAGTAATGGAACCAATTTATGATGAACCGACGACGACTACT |
| AGCGTGCCTTTGTAAGCACAAGCTGATGAGTACGAACTTATGTACTCATTCGTTTCGGAAGAGACAGGTACGTTAATAGT |
| TAATAGCGTACTTCTTTTTCTTGCTTTCGTGGTATTCTTGCTAGTTACACTAGCCATCCTTACTGCGCTTCGATTGTGTG |
| CGTACTGCTGCAATATTGTTAACGTGAGTCTTGTAAAACCTTCTTTTTACGTTTACTCTCGTGTTAAAAATCTGAATTCT |
| TCTAGAGTTCCTGATCTTCTGGTCTAAACGAACTAAATATTATATTAGTTTTTCTGTTTGGAACTTTAATTTTAGCCATG |
| GCAGATTCCAACGGTACTATTACCGTTGAAGAGCTTAAAAAGCTCCTTGAACAATGGAACCTAGTAATAGGTTTCCTATT |
| CCTTACATGGATTTGTCTTCTACAATTTGCCTATGCCAACAGGAATAGGTTTTTGTATATAATTAAGTTAATTTTCCTCT |
| GGCTGTTATGGCCAGTAACTTTAGCTTGTTTTGTGCTTGCTGCTGTTTACAGAATAAATTGGATCACCGGTGGAATTGCT |
| ATCGCAATGGCTTGTCTTGTAGGCTTGATGTGGCTCAGCTACTTCATTGCTTCTTTCAGACTGTTTGCGCGTACGCGTTC |
| CATGTGGTCATTCAATCCAGAAACTAACATTCTTCTCAACGTGCCACTCCATGGCACTATTCTGACCAGACCGCTTCTAG |
| AAAGTGAACTCGTAATCGGAGCTGTGATCCTTCGTGGACATCTTCGTATTGCTGGACACCATCTAGGACGCTGTGACATC |
| AAGGACCTGCCTAAAGAAATCACTGTTGCTACATCACGAACGCTTTCTTATTACAAATTGGGAGCTTCGCAGCGTGTAGC |
| AGGTGACTCAGGTTTTGCTGCATACAGTCGCTACAGGATTGGCAACTATAAATTAAACACAGACCATTCCAGTAGCAGTG |
| ACAATATTGCTTTGCTTGTACAGTAAGTGACAACAGATGTTTCATCTCGTTGACTTTCAGGTTACTATAGCAGAGATATT |
| ACTAATTATTATGAGGACTTTTAAAGTTTCCATTTGGAATCTTGATTACATCATAAACCTCATAATTAAAAATTTATCTA |
| AGTCACTAACTGAGAATAAATATTCTCAATTAGATGAAGAGCAACCAATGGAGATTGATTAAACGAACATGAAAATTATT |
| CTTTTCTTGGCACTGATAACACTCGCTACTTGTGAGCTTTATCACTACCAAGAGTGTGTTAGAGGTACAACAGTACTTTT |
| AAAAGAACCTTGCTCTTCTGGAACATACGAGGGCAATTCACCATTTCATCCTCTAGCTGATAACAAATTTGCACTGACTT |

-continued

| SEQUENCES |
| --- |
| GCTTTAGCACTCAATTTGCTTTTGCTTGTCCTGACGGCGTAAAACACGTCTATCAGTTACGTGCCAGATCAGTTTCACCT |
| AAACTGTTCATCAGACAAGAGGAAGTTCAAGAACTTTACTCTCCAATTTTTCTTATTGTTGCGGCAATAGTGTTTATAAC |
| ACTTTGCTTCACACTCAAAAGAAAGACAGAATGATTGAACTTTCATTAATTGACTTCTATTTGTGCTTTTTAGCCTTTCT |
| GCTATTCCTTGTTTTAATTATGCTTATTATCTTTTGGTTCTCACTTGAACTGCAAGATCATAATGAAACTTGTCACGCCT |
| AAACGAACATGAAATTTCTTGTTTTCTTAGGAATCATCACAACTGTAGCTGCATTTCACCAAGAATGTAGTTTACAGTCA |
| TGTACTCAACATCAACCATATGTAGTTGATGACCCGTGTCCTATTCACTTCTATTCTAAATGGTATATTAGAGTAGGAGC |
| TAGAAAATCAGCACCTTTAATTGAATTGTGCGTGGATGAGGCTGGTTCTAAATCACCCATTCAGTACATCGATATCGGTA |
| ATTATACAGTTTCCTGTTTACCTTTTACAATTAATTGCCAGAAACCTAAATTGGGTAGTCTTGTAGTGCGTTGTTCGTTC |
| TATGAAGACTTTTTAGAGTATCATGACGTTCGTGTTGTTTTAGATTTCATCTAAACGAACAAACAAACTAAAATGTCTGA |
| TAATGGACCCCAAAATCAGCGAAATGCACCCCGCATTACGTTTGGTGGACCCTCAGATTCAACTGGCAGTAACCAGAATG |
| GAGAACGCAGTGGGGCGCGATCAAAACAACGTCGGCCCCAAGGTTTACCCAATAATACTGCGTCTTGGTTCACCGCTCTC |
| ACTCAACATGGCAAGGAAGACCTTAAATTCCCTCGAGGACAAGGCGTTCCAATTAACACCAATAGCAGTCGAGATGACCA |
| AATTGGCTACTACCGAAGAGCTACCAGACGAATTCGTGGTGGTGACGGTAAAATGAAAGATCTCAGTCCAAGATGGTATT |
| TCTACTACCTAGGAACTGGGCCAGAAGCTGGACTTCCCTATGGTGCTAACAAAGACGGCATCATATGGGTTGCAACTGAG |
| GGAGCCTTGAATACACCAAAAGATCACATTGGCACCCGCAATCCTGCTAACAATGCTGCAATCGTGCTACAACTTCCTCA |
| AGGAACAACATTGCCAAAAGGCTTCTACGCAGAAGGGAGCAGAGGCGGCAGTCAAGCCTCTTCTCGTTCCTCATCACGTA |
| GTCGCAACAGTTCAAGAAATTCAACTCCAGGCAGCTCTAAACGAACTTCTCCTGCTAGAATGGCTGGCAATGGCGGTGAT |
| GCTGCTCTTGCTTTGCTGCTGCTTGACAGATTGAACCAGCTTGAGAGCAAAATGTCTGGTAAAGGCCAACAACAACAAGG |
| CCAAACTGTCACTAAGAAATCTGCTGCTGAGGCTTCTAAGAAGCCTCGGCAAAAACGTACTGCCACTAAAGCATACAATG |
| TAACACAAGCTTTCGGCAGACGTGGTCCAGAACAAACCCAAGGAAATTTTGGGGACCAGGAACTAATCAGACAAGGAACT |
| GATTACAAACATTGGCCGCAAATTGCACAATTTGCCCCCAGCGCTTCAGCGTTCTTCGGAATGTCGCGCATTGGCATGGA |
| AGTCACACCTTCGGGAACGTGGTTGACCTACACAGGTGCCATCAAATTGGATGACAAAGATCCAAATTTCAAAGATCAAG |
| TCATTTTGCTGAATAAGCATATTGACGCATACAAAACATTCCCACCAACAGAGCCTAAAAAGGACAAAAAGAAGAAGGCT |
| GATGAAACTCAAGCCTTACCGCAGAGACAGAAGAAACAGCAAACTGTGACTCTTCTTCCTGCTGCAGATTTGGATGATTT |
| CTCCAAACAATTGCAACAATCCATGAGCAGTGCTGACTCAACTCAGGCCTAAACTCATGCAGACCACACAAGGCAGATGG |
| GCTATATAAACGTTTTCGCTTTTCCGTTTACGATATATAGTCTACTCTTGTGCAGAATGAATTCTCGTAACTACATAGCA |
| CAAGTAGATGTAGTTAACTTTAATCTCACATAGCAATCTTTAATCAGTGTGTAACATTAGGGAGGACTTGAAAGAGCCAC |
| CACATTTTCACCGAGGCCACGCGGAGTACGATCGAGTGTACAGTGAACAATGCTAGGGAGAGCTGCCTATATGGAAGAGC |
| CCTAATGTGTAAAATTAATTTTAGTAGTGCTAACCCCATGTGATTTTAATAGCTTCTTA |
| >QQX12069.1 surface glycoprotein, from genome accession MW520923 |
| SEQ ID NO: 21 |
| MFVFLVLLPLVSSQCVNFTNRTQLPSAYTNSFTRGVYYPDKVFRSSVLHSTQDLFLPFFSNVTWFHAIHVSGTNGTKRFDNPVLP |
| FNDGVYFASTEKSNIIRGWIFGTTLDSKTQSLLIVNNATNVVIKVCEFQFCNYPFLGVYYHKNNKSWMESEFRVYSSANNCTFEY |
| VSQPFLMDLEGKQGNFKNLSEFVFKNIDGYFKIYSKHTPINLVRDLPQGFSALEPLVDLPIGINITRFQTLLALHRSYLTPGDSSSG |
| WTAGAAAYYVGYLQPRTFLLKYNENGTITDAVDCALDPLSETKCTLKSFTVEKGIYQTSNFRVQPTESIVRFPNITNLCPFGEVFN |
| ATRFASVYAWNRKRISNCVADYSVLYNSASFSTFKCYGVSPTKLNDLCFTNVYADSFVIRGDEVRQIAPGQTGTIADYNYKLPDD |
| FTGCVIAWNSNNLDSKVGGNYNYLYRLFRKSNLKPFERDISTEIYQAGSTPCNGVKGFNCYFPLQSYGFQPTYGVGYQPYRVVVL |
| SFELLHAPATVCGPKKSTNLVKNKCVNFNFNGLTGTGVLTESNKKFLPFQQFGRDIADTTDAVRDPQTLEILDITPCSFGGVSVIT |
| PGTNTSNQVAVLYQGVNCTEVPVAIHADQLTPTWRVYSTGSNVFQTRAGCLIGAEYVNNSYECDIPIGAGICASYQTQTNSPRR |
| ARSVASQSIIAYTMSLGAENSVAYSNNSIAIPTNFTISVTTEILPVSMTKTSVDCTMYICGDSTECSNLLLQYGSFCTQLNRALTGIA |

| SEQUENCES |
|---|
| VEQDKNTQEVFAQVKQIYKTPPIKDFGGFNFSQILPDPSKPSKRSFIEDLLFNKVTLADAGFIKQYGDCLGDIAARDLICAQKFNGL |
| TVLPPLLTDEMIAQYTSALLAGTITSGWTFGAGAALQIPFAMQMAYRFNGIGVTQNVLYENQKLIANQFNSAIGKIQDSLSSTAS |
| ALGKLQDVVNQNAQALNTLVKQLSSNFGAISSVLNDILSRLDKVEAEVQIDRLITGRLQSLQTYVTQQLIRAAEIRASANLAAIKM |
| SECVLGQSKRVDFCGKGYHLMSFPQSAPHGVVFLHVTYVPAQEKNFTTAPAICHDGKAHFPREGVFVSNGTHWFVTQRNFYE |
| PQIITTDNTFVSGNCDVVIGIVNNTVYDPLQPELDSFKEELDKYFKNHTSPDVDLGDISGINASFVNIQKEIDRLNEVAKNLNESLID |
| LQELGKYEQYIKWPWYIWLGFIAGLIAIVMVTIMLCCMTSCCSCLKGCCSCGSCCKFDEDDSEPVLKGVKLHYT |
| >Severe acute respiratory syndrome coronavirus 2 isolate SARS-CoV-2/human/England/MIG457/2020, EVAg Ref-SKU: 004V-04032, complete genome. UK B 1.1.7 lineage SEQ ID NO: 22 |
| ATTAAAGGTTTATACCTTCCCAGGTAACAAACCAACCAACTTTCGATCTCTTGTAGATCTGTTCTCTAAACGAACTTTAAAAT |
| CTGTGTGGCTGTCACTCGGCTGCATGCTTAGTGCACTCACGCAGTATAATTAATAACTAATTACTGTCGTTGACAGGACAC |
| GAGTAACTCGTCTATCTTCTGCAGGCTGCTTACGGTTTCGTCCGTGTTGCAGCCGATCATCAGCACATCTAGGTTTTGTCCG |
| GGTGTGACCGAAAGGTAAGATGGAGAGCCTTGTCCCTGGTTTCAACGAGAAAACACACGTCCAACTCAGTTTGCCTGTTTT |
| ACAGGTTCGCGACGTGCTCGTACGTGGCTTTGGAGACTCCGTGGAGGAGGTCTTATCAGAGGCACGTCAACATCTTAAAG |
| ATGGCACTTGTGGCTTAGTAGAAGTTGAAAAAGGCGTTTTGCCTCAACTTGAACAGCCCTATGTGTTCATCAAACGTTCGG |
| ATGCTCGAACTGCACCTCATGGTCATGTTATGGTTGAGCTGGTAGCAGAACTCGAAGGCATTCAGTACGGTCGTAGTGGT |
| GAGACACTTGGTGTCCTTGTCCCTCATGTGGGCGAAATACCAGTGGCTTACCGCAAGGTTCTTCTTCGTAAGAACGGTAAT |
| AAAGGAGCTGGTGGCCATAGTTACGGCGCCGATCTAAAGTCATTTGACTTAGGCGACGAGCTTGGCACTGATCCTTATGA |
| AGATTTTCAAGAAAACTGGAACACTAAACATAGCAGTGGTGTTACCCGTGAACTCATGCGTGAGCTTAACGGAGGGGCAT |
| ACACTCGCTATGTCGATAACAACTTCTGTGGCCCTGATGGCTACCCTCTTGAGTGCATTAAAGACCTTCTAGCACGTGCTGG |
| TAAAGCTTCATGCACTTTGTCTGAACAACTGGACTTTATTGACACTAAGAGGGGTGTATACTGCTGCCGTGAACATGAGCA |
| TGAAATTGCTTGGTACACGGAACGTTCTGAAAAGAGCTATGAATTGCAGACACCTTTTGAAATTAAATTGGCAAAGAAATT |
| TGACACCTTCAATGGGGAATGTCCAAATTTTGTATTTCCCTTAAATTCCATAATCAAGACTATTCAACCAAGGGTTGAAAAG |
| AAAAAGCTTGATGGCTTTATGGGTAGAATTCGATCTGTCTATCCAGTTGCGTCACCAAATGAATGCAACCAAATGTGCCTTT |
| CAACTCTCATGAAGTGTGATCATTGTGGTGAAACTTCATGGCAGACGGGCGATTTTGTTAAAGCCACTTGCGAATTTTGTG |
| GCACTGAGAATTTGACTAAAGAAGGTGCCACTACTTGTGGTTACTTACCCCAAAATGCTGTTGTTAAAATTTATTGTCCAGC |
| ATGTCACAATTCAGAAGTAGGACCTGAGCATAGTCTTGCCGAATACCATAATGAATCTGGCTTGAAAACCATTCTTCGTAA |
| GGGTGGTCGCACTATTGCCTTTGGAGGCTGTGTGTTCTCTTATGTTGGTTGCCATAACAAGTGTGCCTATTGGGTTCCACGT |
| GCTAGCGCTAACATAGGTTGTAACCATACAGGTGTTGTTGGAGAAGGTTCCGAAGGTCTTAATGACAACCTTCTTGAAATA |
| CTCCAAAAGAGAAAGTCAACATCAATATTGTTGGTGACTTTAAACTTAATGAAGAGATCGCCATTATTTGGCATCTTTTT |
| CTGCTTCCACAAGTGCTTTTGTGGAAACTGTGAAAGGTTTGGATTATAAAGCATTCAAACAAATTGTTGAATCCTGTGGTA |
| ATTTTAAAGTTACAAAAGGAAAAGCTAAAAAAGGTGCCTGGAATATTGGTGAACAGAAATCAATACTGAGTCCTCTTTATG |
| CATTTGCATCAGAGGCTGCTCGTGTTGTACGATCAATTTTCTCCCGCACTCTTGAAACTGCTCAAAATTCTGTGCGTGTTTTA |
| CAGAAGGCCGCTATAACAATACTAGATGGAATTTCACAGTATTCACTGAGACTCATTGATGCTATGATGTTCACATCTGATT |
| TGGCTACTAACAATCTAGTTGTAATGGCCTACATTACAGGTGGTGTTGTTCAGTTGACTTCGCAGTGGCTAACTAACATCTT |
| TGGCACTGTTTATGAAAAACTCAAACCCGTCCTTGATTGGCTTGAAGAGAAGTTTAAGGAAGGTGTAGAGTTTCTTAGAGA |
| CGGTTGGGAAATTGTTAAATTTATCTCAACCTGTGCTTGTGAAATTGTCGGTGGACAAATTGTCACCTGTGCAAAGGAAAT |
| TAAGGAGAGTGTTCAGACATTCTTTAAGCTTGTAAATAAATTTTTGGCTTTGTGTGCTGACTCTATCATTATTGGTGGAGCT |
| AAACTTAAAGCCTTGAATTTAGGTGAAACATTTGTCACGCACTCAAAGGGATTGTACAGAAAGTGTGTTAAATCCAGAGAA |
| GAAACTGGCCTACTCATGCCTCTAAAAGCCCCAAAAGAAATTATCTTCTTAGAGGGAGAAACACTTCCCACAGAAGTGTTA |

-continued

| SEQUENCES |
|---|
| ACAGAGGAAGTTGTCTTGAAAACTGGTGATTTACAACCATTAGAACAACCTACTAGTGAAGCTGTTGAAGCTCCATTGGTT |
| GGTACACCAGTTTGTATTAACGGGCTTATGTTGCTCGAAATCAAAGACACAGAAAAGTACTGTGCCCTTGCACCTAATATG |
| ATGGTAACAAACAATACCTTCACACTCAAAGGCGGTGCACCAACAAAGGTTACTTTTGGTGATGACACTGTGATAGAAGTG |
| CAAGGTTACAAGAGTGTGAATATCACTTTTGAACTTGATGAAAGGATTGATAAAGTACTTAATGAGAAGTGCTCTGCCTAT |
| ACAGTTGAACTCGGTACAGAAGTAAATGAGTTCGCCTGTGTTGTGGCAGATGCTGTCATAAAAACTTTGCAACCAGTATCT |
| GAATTACTTACACCACTGGGCATTGATTTAGATGAGTGGAGTATGGCTACATACTACTTATTTGATGAGTCTGGTGAGTTTA |
| AATTGGCTTCACATATGTATTGTTCTTTTTACCCTCCAGATGAGGATGAAGAAGAAGGTGATTGTGAAGAAGAAGAGTTTG |
| AGCCATCAACTCAATATGAGTATGGTACTGAAGATGATTACCAAGGTAAACCTTTGGAATTTGGTGCCACTTCTGCTGCTCT |
| TCAACCTGAAGAAGAGCAAGAAGAAGATTGGTTAGATGATGATAGTCAACAAACTGTTGGTCAACAAGACGGCAGTGAG |
| GACAATCAGACAACTATTATTCAAACAATTGTTGAGGTTCAACCTCAATTAGAGATGGAACTTACACCAGTTGTTCAGACTA |
| TTGAAGTGAATAGTTTTAGTGGTTATTTAAAACTTACTGACAATGTATACATTAAAAATGCAGACATTGTGGAAGAAGCTA |
| AAAAGGTAAAACCAACAGTGGTTGTTAATGCAGCCAATGTTTACCTTAAACATGGAGGAGGTGTTGCAGGAGCCTTAAAT |
| AAGGCTACTAACAATGCCATGCAAGTTGAATCTGATGATTACATAGCTACTAATGGACCACTTAAAGTGGGTGGTAGTTGT |
| GTTTTAAGCGGACACAATCTTGCTAAACACTGTCTTCATGTTGTCGGCCCAAATGTTAACAAAGGTGAAGACATTCAACTTC |
| TTAAGAGTGCTTATGAAAATTTTAATCAGCACGAAGTTCTACTTGCACCATTATTATCAGCTGGTATTTTTGGTGCTGACCCT |
| ATACATTCTTTAAGAGTTTGTGTAGATACTGTTCGCACAAATGTCTACTTAGCTGTCTTTGATAAAAATCTCTATGACAAACT |
| TGTTTCAAGCTTTTTGGAAATGAAGAGTGAAAAGCAAGTTGAACAAAAGATCGCTGAGATTCCTAAAGAGGAAGTTAAGC |
| CATTTATAACTGAAAGTAAACCTTCAGTTGAACAGAGAAAACAAGATGATAAGAAAATCAAAGCTTGTGTTGAAGAAGTT |
| ACAACAACTCTGGAAGAAACTAAGTTCCTCACAGAAAACTTGTTACTTTATATTGACATTAATGGCAATCTTCATCCAGATT |
| CTGCCACTCTTGTTAGTGACATTGACATCACTTTCTTAAAGAAAGATGCTCCATATATAGTGGGTGATGTTGTTCAAGAGGG |
| TGTTTTAACTGCTGTGGTTATACCTACTAAAAAGGCTGGTGGCACTACTGAAATGCTAGCGAAAGCTTTGAGAAAAGTGCC |
| AACAGACAATTATATAACCACTTACCCGGGTCAGGGTTTAAATGGTTACACTGTAGAGGAGGCAAAGACAGTGCTTAAAA |
| AGTGTAAAAGTGCCTTTTACATTCTACCATCTATTATCTCTAATGAGAAGCAAGAAATTCTTGGAACTGTTTCTTGGAATTTG |
| CGAGAAATGCTTGCACATGCAGAAGAAACACGCAAATTAATGCCTGTCTGTGTGGAAACTAAAGCCATAGTTTCAACTATA |
| CAGCGTAAATATAAGGGTATTAAAATACAAGAGGGTGTGGTTGATTATGGTGCTAGATTTTACTTTTACACCAGTAAAACA |
| ACTGTAGCGTCACTTATCAACACACTTAACGATCTAAATGAAACTCTTGTTACAATGCCACTTGGCTATGTAACACATGGCT |
| TAAATTTGGAAGAAGCTGCTCGGTATATGAGATCTCTCAAAGTGCCAGCTACAGTTTCTGTTTCTTCACCTGATGCTGTTAC |
| AGCGTATAATGGTTATCTTACTTCTTCTTCTAAAACACCTGAAGAACATTTTATTGAAACCATCTCACTTGCTGGTTCCTATA |
| AAGATTGGTCCTATTCTGGACAATCTACACAACTAGGTATAGAATTTCTTAAGAGAGGTGATAAAAGTGTATATTACACTA |
| GTAATCCTACCACATTCCACCTAGATGGTGAAGTTATCACCTTTGACAATCTTAAGACACTTCTTTCTTTGAGAGAAGTGAG |
| GACTATTAAGGTGTTTACAACAGTAGACAACATTAATCTCCACACGCAAGTTGTGGACATGTCAATGACATATGGACAACA |
| GTTTGGTCCAACTTATTTGGATGGAGCTGATGTTACTAAAATAAAACCTCATAATTCACATGAAGGTAAAACATTTTATGTT |
| TTACCTAATGATGACACTCTACGTGTTGAGGCTTTTGAGTACTACCACACAACTGATCCTAGTTTTCTGGGTAGGTACATGT |
| CAGCATTAAATCACACTAAAAAGTGGAAATACCCACAAGTTAATGGTTTAACTTCTATTAAATGGGCAGATAACAACTGTT |
| ATCTTGCCACTGCATTGTTAACACTCCAACAAATAGAGTTGAAGTTTAATCCACCTGCTCTACAAGATGCTTATTACAGAGC |
| AAGGGCTGGTGAAGCTGATAACTTTTGTGCACTTATCTTAGCCTACTGTAATAAGACAGTAGGTGAGTTAGGTGATGTTAG |
| AGAAACAATGAGTTACTTGTTTCAACATGCCAATTTAGATTCTTGCAAAAGAGTCTTGAACGTGGTGTGTAAAACTTGTGG |
| ACAACAGCAGACAACCCTTAAGGGTGTAGAAGCTGTTATGTACATGGGCACACTTTCTTATGAACAATTTAAGAAAGGTGT |

| SEQUENCES |
|---|
| TCAGATACCTTGTACGTGTGGTAAACAAGCTACAAAATATCTAGTACAACAGGAGTCACCTTTTGTTATGATGTCAGCACCA |
| CCTGCTCAGTATGAACTTAAGCATGGTACATTTACTTGTGCTAGTGAGTACACTGGTAATTACCAGTGTGGTCACTATAAAC |
| ATATAACTTCTAAAGAAACTTTGTATTGCATAGACGGTGCTTTACTTACAAAGTCCTCAGAATACAAAGGTCCTATTACGGA |
| TGTTTTCTACAAAGAAAACAGTTACACAACAACCATAAAACCAGTTACTTATAAATTGGATGGTGTTGTTTGTACAGAAATT |
| GACCCTAAGTTGGACAATTATTATAAGAAAGACAATTCTTATTTTACAGAGCAACCAATTGATCTTGTACCAAACCAACCAT |
| ATCCAAACGCAAGCTTCGATAATTTTAAGTTTGTATGTGATAATATCAAATTTGCTGATGATTTAAACCAGTTAACTGGTTA |
| TAAGAAACCTGCTTCAAGAGAGCTTAAAGTTACATTTTTCCCTGACTTAAATGGTGATGTGGTGGCTATTGATTATAAACAC |
| TACACACCCTCTTTTAAGAAAGGAGCTAAATTGTTACATAAACCTATTGTTTGGCATGTTAACAATGCAACTAATAAAGCCA |
| CGTATAAACCAAATACCTGGTGTATACGTTGTCTTTGGAGCACAAAACCAGTTGAAACATCAAATTCGTTTGATGTACTGAA |
| GTCAGAGGACGCGCAGGGAATGGATAATCTTGCCTGCGAAGATCTAAAACCAGTCTCTGAAGAAGTAGTGGAAAATCCTA |
| CCATACAGAAAGACGTTCTTGAGTGTAATGTGAAAACTACCGAAGTTGTAGGAGACATTATACTTAAACCAGCAAATAATA |
| GTTTAAAAATTACAGAAGAGGTTGGCCACACAGATCTAATGGCTGCTTATGTAGACAATTCTAGTCTTACTATTAAGAAAC |
| CTAATGAATTATCTAGAGTATTAGGTTTGAAAACCCTTGTTACTCATGGTTTAGCTGCTGTTAATAGTGTCCCTTGGGATAC |
| TATAGCTAATTATGCTAAGCCTTTTCTTAACAAAGTTGTTAGTACAACTACTAACATAGTTACACGGTGTTTAAACCGTGTTT |
| GTACTAATTATATGCCTTATTTCTTTACTTTATTGCTACAATTGTGTACTTTTACTAGAAGTACAAATTCTAGAATTAAAGCAT |
| CTATGCCGACTACTATAGCAAAGAATACTGTTAAGAGTGTCGGTAAATTTTGTCTAGAGGCTTCATTTAATTATTTGAAGTC |
| ACCTAATTTTTCTAAACTGATAAATATTACAATTTGGTTTTTACTATTAAGTGTTTGCCTAGGTTCTTTAATCTACTCAACCGC |
| TGCTTTAGGTGTTTTAATGTCTAATTTAGGCATGCCTTCTTACTGTACTGGTTACAGAGAAGGCTATTTGAACTCTACTAATG |
| TCACTATTGCAACCTACTGTACTGGTTCTATACCTTGTAGTGTTTGTCTTAGTGGTTTAGATTCTTTAGACACCTATCCTTCTT |
| TAGAAACTATACAAATTACCATTTCATCTTTTAAATGGGATTTAACTGCTTTTGGCTTAGTTGCAGAGTGGTTTTGGCATAT |
| ATTCTTTTCACTAGGTTTTTCTATGTACTTGGATTGGCTGCAATCATGCAATTGTTTTTCAGCTATTTTGCAGTACATTTTATT |
| AGTAATTCTTGGCTTATGTGGTTAATAATTAATCTTGTACAAATGGCCCCGATTTCAGCTATGGTTAGAATGTACATCTTCTT |
| TGCATCATTTTATTATGTATGGAAAAGTTATGTGCATGTTGTAGACGGTTGTAATTCATCAACTTGTATGATGTGTTACAAA |
| CGTAATAGAGCAACAAGAGTCGAATGTACAACTATTGTTAATGGTGTTAGAAGGTCCTTTTATGTCTATGCTAATGGAGGT |
| AAAGGCTTTTGCAAACTACACAATTGGAATTGTGTTAATTGTGATACATTCTGTGCTGGTAGTACATTTATTAGTGATGAAG |
| TTGCGAGAGACTTGTCACTACAGTTTAAAAGACCAATAAATCCTACTGACCAGTCTTCTTACATCGTTGATAGTGTTACAGT |
| GAAGAATGGTTCCATCCATCTTTACTTTGATAAAGCTGGTCAAAAGACTTATGAAAGACATTCTCTCTCTCATTTTGTTAACT |
| TAGACAACCTGAGAGCTAATAACACTAAAGGTTCATTGCCTATTAATGTTATAGTTTTTGATGGTAAATCAAATGTGAAG |
| AATCATCTGCAAAATCAGCGTCTGTTTACTACAGTCAGCTTATGTGTCAACCTATACTGTTACTAGATCAGGCATTAGTGTC |
| TGATGTTGGTGATAGTGCGGAAGTTGCAGTTAAAATGTTTGATGCTTACGTTAATACGTTTTCATCAACTTTTAACGTACCA |
| ATGGAAAAACTCAAAACACTAGTTGCAACTGCAGAAGCTGAACTTGCAAAGAATGTGTCCTTAGACAATGTCTTATCTACT |
| TTTATTTCAGCAGCTCGGCAAGGGTTTGTTGATTCAGATGTAGAAACTAAAGATGTTGTTGAATGTCTTAAATTGTCACATC |
| AATCTGACATAGAAGTTACTGGCGATAGTTGTAATAACTATATGCTCACCTATAACAAAGTTGAAAACATGACACCCCGTG |
| ACCTTGGTGCTTGTATTGACTGTAGTGCGCGTCATATTAATGCGCAGGTAGCAAAAAGTCACAACATTGCTTTGATATGGA |
| ACGTTAAAGATTTCATGTCATTGTCTGAACAACTACGAAAACAAATACGTAGTGCTGCTAAAAGAATAACTTACCTTTTAA |
| GTTGACATGTGCAACTACTAGACAAGTTGTTAATGTTGTAACAACAAAGATAGCACTTAAGGGTGGTAAAATTGTTAATAA |
| TTGGTTGAAGCAGTTAATTAAAGTTACACTTGTGTTCCTTTTTGTTGCTGCTATTTTCTATTTAATAACACCTGTTCATGTCAT |
| GTCTAAACATACTGACTTTTCAAGTGAAATCATAGGATACAAGGCTATTGATGGTGGTGTCACTCGTGACATAGCATCTAC |
| AGATACTTGTTTTGCTAACAAACATGCTGATTTTGACACATGGTTTAGCCAGCGTGGTGGTAGTTATACTAATGACAAAGCT |

-continued

SEQUENCES

TGCCCATTGATTGCTGCAGTCATAACAAGAGAAGTGGGTTTTGTCGTGCCTGGTTTGCCTGGCACGATATTACGCACAACT

AATGGTGACTTTTTGCATTTCTTACCTAGAGTTTTTAGTGCAGTTGGTAACATCTGTTACACACCATCAAAACTTATAGAGTA

CACTGACTTTGCAACATCAGCTTGTGTTTTGGCTGCTGAATGTACAATTTTTAAAGATGCTTCTGGTAAGCCAGTACCATAT

TGTTATGATACCAATGTACTAGAAGGTTCTGTTGCTTATGAAAGTTTACGCCCTGACACACGTTATGTGCTCATGGATGGCT

CTATTATTCAATTTCCTAACACCTACCTTGAAGGTTCTGTTAGAGTGGTAACAACTTTTGATTCTGAGTACTGTAGGCACGG

CACTTGTGAAAGATCAGAAGCTGGTGTTTGTGTATCTACTAGTGGTAGATGGGTACTTAACAATGATTATTACAGATCTTTA

CCAGGAGTTTTCTGTGGTAGATGCTGTAAATTTACTTACTAATATGTTTACACCACTAATTCAACCTATTGGTGCTTTGGA

CATATCAGCATCTATAGTAGCTGGTGGTATTGTAGCTATCGTAGTAACATGCCTTGCCTACTATTTTATGAGGTTTAGAAGA

GCTTTTGGTGAATACAGTCATGTAGTTGCCTTTAATACTTTACTATTCCTTATGTCATTCACTGTACTCTGTTTAACACCAGTT

TACTCATTCTTACCTGGTGTTTATTCTGTTATTTACTTGTACTTGACATTTTATCTTACTAATGATGTTTCTTTTTTAGCACATA

TTCAGTGGATGGTTATGTTCACACCTTTAGTACCTTTCTGGATAACAATTGCTTATATCATTTGTATTTCCACAAAGCATTTCT

AUGGTTCTTTAGTAATTACCTAAAGAGACGTGTAGTCTTTAATGGTGTTTCCTTTAGTACTTTTGAAGAAGCTGCGCTGTG

CACCTTTTTGTTAAATAAAGAAATGTATCTAAAGTTGCGTAGTGATGTGCTATTACCTCTTACGCAATATAATAGATACTTA

GCTCTTTATAATAAGTACAAGTATTTTAGTGGAGCAATGGATACAACTAGCTACAGAGAAGCTGCTTGTTGTCATCTCGCA

AAGGCTCTCAATGACTTCAGTAACTCAGGTTCTGATGTTCTTTACCAACCACCACAAACCTCTATCACCTCAGCTGTTTTGCA

GAGTGGTTTTAGAAAAATGGCATTCCCATCTGGTAAAGTTGAGGGTTGTATGGTACAAGTAACTTGTGGTACAACTACACT

TAACGGTCTTTGGCTTGATGACGTAGTTTACTGTCCAAGACATGTGATCTGCACCTCTGAAGACATGCTTAACCCTAATTAT

GAAGATTTACTCATTCGTAAGTCTAATCATAATTTCTTGGTACAGGCTGGTAATGTTCAACTCAGGGTTATTGGACATTCTA

TGCAAAATTGTGTACTTAAGCTTAAGGTTGATACAGCCAATCCTAAGACACCTAAGTATAAGTTTGTTCGCATTCAACCAGG

ACAGACTTTTTCAGTGTTAGCTTGTTACAATGGTTCACCATCTGGTGTTTACCAATGTGCTATGAGGCCCAATTTCACTATTA

AGGGTTCATTCCTTAATGGTTCATGTGGTAGTGTTGGTTTTAACATAGATTATGACTGTGTCTCTTTTTGTTACATGCACCAT

ATGGAATTACCAACTGGAGTTCATGCTGGCACAGACTTAGAAGGTAACTTTTATGGACCTTTTGTTGACAGGCAAACAGCA

CAAGCAGCTGGTACGGACACAACTATTACAGTTAATGTTTTAGCTTGGTTGTACGCTGCTGTTATAAATGGAGACAGGTGG

TTTCTCAATCGATTTACCACAACTCTTAATGACTTTAACCTTGTGGCTATGAAGTACAATTATGAACCTCTAACACAAGACCA

TGTTGACATACTAGGACCTCTTTCTGCTCAAACTGGAATTGCCGTTTTAGATATGTGCTTCATTAAAAGAATTACTGCAA

AATGGTATGAATGGACGTACCATATTGGGTAGTGCTTTATTAGAAGATGAATTTACACCTTTTGATGTTGTTAGACAATGCT

CAGGTGTTACTTTCCAAAGTGCAGTGAAAAGAACAATCAAGGGTACACACCACTGGTTGTTACTCACAATTTTGACTTCACT

TTTAGTTTTAGTCCAGAGTACTCAATGGTCTTTGTTCTTTTTTTGTATGAAAATGCCTTTTTACCTTTTGCTATGGGTATTAT

TGCTATGTCTGCTTTTGCAATGATGTTTGTCAAACATAAGCATGCATTTCTCTGTTTGTTTTTGTTACCTTCTCTTGCCACTGT

AGCTTATTTTAATATGGTCTATATGCCTGCTAGTTGGGTGATGCGTATTATGACATGGTTGGATATGGTTGATACTAGTTTG

AAGCTAAAAGACTGTGTTATGTATGCATCAGCTGTAGTGTTACTAATCCTTATGACAGCAAGAACTGTATGATGATGGT

GCTAGGAGAGTGTGGACACTTATGAATGTCTTGACACTCGTTTATAAAGTTTATTATGGTAATGCTTTAGATCAAGCCATTT

CCATGTGGGCTCTTATAATCTCTGTTACTTCTAACTACTCAGGTGTAGTTACAACTGTCATGTTTTTGGCCAGAGGTATTGTT

TTTATGTGTGTTGAGTATTGCCCTATTTTCTTCATAACTGGTAATACACTTCAGTGTATAATGCTAGTTTATTGTTTCTTAGGC

TATTTTTGTACTTGTTACTTTGGCCTCTTTTGTTTACTCAACCGCTACTTTAGACTGACTCTTGGTGTTTATGATTACTTAGTTT

CTACACAGGAGTTTAGATATATGAATTCACAGGGACTACTCCCACCCAAGAATAGCATAGATGCCTTCAAACTCAACATTA

AATTGTTGGGTGTTGGTGGCAAACCTTGTATCAAAGTAGCCACTGTACAGTCTAAAATGTCAGATGTAAAGTGCACATCAR

TAGTCTTACTCTCAGTTTTGCAACAACTCAGAGTAGAATCATCATCTAAATTGTGGGCTCAATGTGTCCAGTTACACAATGA

| SEQUENCES |
|---|
| CATTCTCTTAGCTAAAGATACTACTGAAGCCTTTGAAAAAATGGTTTCACTACTTTCTGTTTTGCTTTCCATGCAGGGTGCTG |
| TAGACATAAACAAGCTTTGTGAAGAAATGCTGGACAACAGGGCAACCTTACAAGCTATAGCCTCAGAGTTTAGTTCCCTTC |
| CATCATATGCAGCTTTTGCTACTGCTCAAGAAGCTTATGAGCAGGCTGTTGCTAATGGTGATTCTGAAGTTGTTCTTAAAAA |
| GTTGAAGAAGTCTTTGAATGTGGCTAAATCTGAATTTGACCGTGATGCAGCCATGCAACGTAAGTTGGAAAAGATGGCTG |
| ATCAAGCTATGACCCAAATGTATAAACAGGCTAGATCTGAGGACAAGAGGGCAAAAGTTACTAGTGCTATGCAGACAATG |
| CTTTTCACTATGCTTAGAAAGTTGGATAATGATGCACTCAACAACATTATCAACAATGCAAGAGATGGTTGTGTTCCCTTGA |
| ACATAATACCTCTTACAACAGCAGCCAAACTAATGGTTGTCATACCAGACTATAACACATATAAAAATACGTGTGATGGTA |
| CAACATTTACTTATGCATCAGCATTGTGGGAAATCCAACAGGTTGTAGATGCAGATAGTAAAATTGTTCAACTTAGTGAAA |
| TTAGTATGGACAATTCACCTAATTTAGCATGGCCTCTTATTGTAACAGCTTTAAGGGCCAATTCTGCTGTCAAATTACAGAA |
| TAATGAGCTTAGTCCTGTTGCACTACGACAGATGTCTTGTGCTGCCGGTACTACACAAACTGCTTGCACTGATGACAATGC |
| GTTAGCTTACTACAACACAACAAAGGGAGGTAGGTTTGTACTTGCACTGTTATCCGATTTACAGGATTTGAAATGGGCTAG |
| ATTCCCTAAGAGTGATGGAACTGGTACTATCTATACAGAACTGGAACCACCTTGTAGGTTTGTTACAGACACACCTAAAGG |
| TCCTAAAGTGAAGTATTTATACTTTATTAAAGGATTAAACAACCTAAATAGAGGTATGGTACTTGGTAGTTTAGCTGCCACA |
| GTACGTCTACAAGCTGGTAATGCAACAGAAGTGCCTGCCAATTCAACTGTATTATCTTTCTGTGCTTTTGCTGTAGATGCTG |
| CTAAAGCTTACAAAGATTATCTAGCTAGTGGGGGACAACCAATCACTAATTGTGTTAAGATGTTGTGTACACACACTGGTA |
| CTGGTCAGGCAATAACAGTTACACCGGAAGCCAATATGGATCAAGAATCCTTTGGTGGTGCATCGTGTTGTCTGTACTGCC |
| GTTGCCACATAGATCATCCAAATCCTAAAGGATTTTGTGACTTAAAAGGTAAGTATGTACAAATACCTACAACTTGTGCTAA |
| TGACCCTGTGGGTTTTACACTTAAAAACACAGTCTGTACCGTCTGCGGTATGTGGAAAGGTTATGGCTGTAGTTGTGATCA |
| ACTCCGCGAACCCATGCTTCAGTCAGCTGATGCACAATCGTTTTTAAACGGGTTTGCGGTGTAAGTGCAGCCCGTCTTACA |
| CCGTGCGGCACAGGCACTAGTACTGATGTCGTATACAGGGCTTTTGACATCTACAATGATAAAGTAGCTGGTTTTGCTAAA |
| TTCCTAAAAACTAATTGTTGTCGCTTCCAAGAAAAGGACGAAGATGACAATTTAATTGATTCTTACTTTGTAGTTAAGAGAC |
| ACACTTTCTCTAACTACCAACATGAAGAAACAATTTATAATTTACTTAAGGATTGTCCAGCTGTTGCTAAACATGACTTCTTT |
| AAGTTTAGAATAGACGGTGACATGGTACCACATATATCACGTCAACGTCTTACTAAATACACAATGGCAGACCTCGTCTAT |
| GCTTTAAGGCATTTTGATGAAGGTAATTGTGACACATTAAAAGAAATACTTGTCACATACAATTGTTGTGATGATGATTATT |
| TCAATAAAAAGGACTGGTATGATTTTGTAGAAAACCCAGATATATTACGCGTATACGCCAACTTAGGTGAACGTGTACGCC |
| AAGCTTTGTTAAAAACAGTACAATTCTGTGATGCCATGCGAAATGCTGGTATTGTTGGTGTACTGACATTAGATAATCAAG |
| ATCTCAATGGTAACTGGTATGATTTCGGTGATTTCATACAAACCACGCCAGGTAGTGGAGTTCCTGTTGTAGATTCTTATTA |
| TTCATTGTTAATGCCTATATTAACCTTGACCAGGGCTTTAACTGCAGAGTCACATGTTGACACTGACTTAACAAAGCCTTAC |
| ATTAAGTGGGATTTGTTAAAATATGACTTCACGGAAGAGAGGTTAAAACTCTTTGACCGTTATTTTAAATATTGGGATCAG |
| ACATACCACCCAAATTGTGTTAACTGTTTGGATGACAGATGCATTCTGCATTGTGCAAACTTTAATGTTTTATTCTCTACAGT |
| GTTCCCACTTACAAGTTTTGGACCACTAGTGAGAAAAATATTTGTTGATGGTGTTCCATTTGTAGTTTCAACTGGATACCAC |
| TTCAGAGAGCTAGGTGTTGTACATAATCAGGATGTAAACTTACATAGCTCTAGACTTAGTTTTAAGGAATTACTTGTGTATG |
| CTGCTGACCCTGCTATGCACGCTGCTTCTGGTAATCTATTACTAGATAAACGCACTACGTGCTTTTCAGTAGCTGCACTTACT |
| AACAATGTTGCTTTTCAAACTGTCAAACCTGGTAATTTTAACAAAGACTTCTATGACTTTGCTGTGTCTAAGGGTTTCTTTAA |
| GGAAGGAAGTTCTGTTGAATTAAAACACTTCTTCTTTGCTCAGGATGGTAATGCTGCTATCAGCGATTATGACTACTATCGT |
| TATAATCTACCAACAATGTGTGATATCAGACAACTACTATTTGTAGTTGAAGTTGTTGATAAGTACTTTGATTGTTACGATG |
| GTGGCTGTATTAATGCTAACCAAGTCATCGTCAACAACCTAGACAAATCAGCTGGTTTTCCATTTAATAAATGGGGTAAGG |
| CTAGACTTTATTATGATTCAATGAGTTATGAGGATCAAGATGCACTTTTCGCATATACAAAACGTAATGTCATCCCTACTAT |
| AACTCAAATGAATCTTAAGTATGCCATTAGTGCAAAGAATAGAGCTCGCACCGTAGCTGGTGTCTCTATCTGTAGTACTAT |

```
GACCAATAGACAGTTTCATCAAAAATTATTGAAATCAATAGCCGCCACTAGAGGAGCTACTGTAGTAATTGGAACAAGCAA

ATTCTATGGTGGTTGGCACAACATGTTAAAAACTGTTTATAGTGATGTAGAAAACCCTCATCTTATGGGTTGGGATTATCCT

AAATGTGATAGAGCCATGCCTAACATGCTTAGAATTATGGCCTCACTTGTTCTTGCTCGCAAACATACAACGTGTTGTAGCT

TGTCACACCGTTTCTATAGATTAGCTAATGAGTGTGCTCAAGTATTGAGTGAAATGGTCATGTGTGGCGGTTCACTATATGT

TAAACCAGGTGGAACCTCATCAGGAGATGCCACAACTGCTTATGCTAATAGTGTTTTTAACATTTGTCAAGCTGTCACGGC

CAATGTTAATGCACTTTTATCTACTGATGGTAACAAAATTGCCGATAAGTATGTCCGCAATTTACAACACAGACTTTATGAG

TGTCTCTATAGAAATAGAGATGTTGACACAGACTTTGTGAATGAGTTTTACGCATATTTGCGTAAACATTTCTCAATGATGA

TACTCTCTGACGATGCTGTTGTGTGTTTCAATAGCACTTATGCATCTCAAGGTCTAGTGGCTAGCATAAAGAACTTTAAGTC

AGTTCTTTATTATCAAAACAATGTTTTTATGTCTGAAGCAAAATGTTGGACTGAGACTGACCTTACTAAAGGACCTCATGAA

TTTTGCTCTCAACATACAATGCTAGTTAAACAGGGTGATGATTATGTGTACCTTCCTTACCCAGATCCATCAAGAATCCTAG

GGGCCGGCTGTTTTGTAGATGATATCGTAAAAACAGATGGTACACTTATGATTGAACGGTTCGTGTCTTTAGCTATAGATG

CTTACCCACTTACTAAACATCCTAATCAGGAGTATGCTGATGTCTTTCATTTGTACTTACAATACATAAGAAAGCTACATGAT

GAGTTAACAGGACACATGTTAGACATGTATTCTGTTATGCTTACTAATGATAACACCTCAAGGTATTGGGAACCTGAGTTTT

ATGAGGCTATGTACACACCGCATACAGTCTTACAGGCTGTTGGGGCTTGTGTTCTTTGCAATTCACAGACTTCATTAAGATG

TGGTGCTTGCATACGTAGACCATTCTTATGTTGTAAATGCTGTTACGACCATGTCATATCAACATCACATAAATTAGTCTTGT

CTGTTAATCCGTATGTTTGCAATGCTCCAGGTTGTGATGTCACAGATGTGACTCAACTTTACTTAGGAGGTATGAGCTATTA

TTGTAAATCACATAAACCACCCATTAGTTTTCCATTGTGTGCTAATGGACAAGTTTTTGGTTTATATAAAAATACATGTGTTG

GTAGCGATAATGTTACTGACTTTAATGCAATTGCAACATGTGACTGGACAAATGCTGGTGATTACATTTTAGCTAACACCTG

TACTGAAAGACTCAAGCTTTTTGCAGCAGAAACGCTCAAAGCTACTGAGGAGACATTTAAACTGTCTTATGGTATTGCTAC

TGTACGTGAAGTGCTGTCTGACAGAGAATTACATCTTTCATGGGAAGTTGGTAAACCTAGACCACCACTTAACCGAAATTA

TGTCTTTACTGGTTATCGTGTAACTAAAAACAGTAAAGTACAAATAGGAGAGTACACCTTTGAAAAAGGTGACTATGGTGA

TGCTGTTGTTTACCGAGGTACAACAACTTACAAATTAAATGTTGGTGATTATTTTGTGCTGACATCACATACAGTAATGCCA

TTAAGTGCACCTACACTAGTGCCACAAGAGCACTATGTTAGAATTACTGGCTTATACCCAACACTCAATATCTCAGATGAG

TTTTCTAGCAATGTTGCAAATTATCAAAAGGTTGGTATGCAAAAGTATTCTACACTCCAGGGACCACCTGGTACTGGTAAG

AGTCATTTTGCTATTGGCCTAGCTCTCTACTACCCTTCTGCTCGCATAGTGTATACAGCTTGCTCTCATGCCGCTGTTGATGC

ACTATGTGAGAAGGCATTAAAATATTTGCCTATAGATAAATGTAGTAGAATTATACCTGCACGTGCTCGTGTAGAGTGTTT

TGATAAAATTCAAAGTGAATTCAACATTAGAACAGTATGTCTTTTGTACTGTAAATGCATTGCCTGAGACGACAGCAGATAT

AGTTGTCTTTGATGAAATTTCAATGGCCACAAATTATGATTTGAGTGTTGTCAATGCCAGATTACGTGCTAAGCACTATGTG

TACATTGGCGACCCTGCTCAATTACCTGCACCACGCACATTGCTAACTAAGGGCACACTAGAACCAGAATATTTCAATTCAG

TGTGTAGACTTATGAAAACTATAGGTCCAGACATGTTCCTCGGAACTTGTCGGCGTTGTCCTGCTGAAATTGTTGACACTGT

GAGTGCTTTGGTTTATGATAATAGGCTTAAAGCACATAAAGACAAATCAGCTCAATGCTTTAAAATGTTTTATAAGGGTGT

TATCACGCATGATGTTTCATCTGCAATTAACAGGCCACAAATAGGCGTGGTAAGAGAATTCCTTACACGTAACCCTGCTG

GAGAAAAGCTGTCTTTATTTCACCTTATAATTCACAGAATGCTGTAGCCTCAAAGATTTTGGGACTACCAACTCAAACTGTT

GATTCATCACAGGGCTCAGAATATGACTATGTCATATTCACTCAAACCACTGAAACAGCTCACTCTTGTAATGTAAACAGAT

TTAATGTTGCTATTACCAGAGCAAAAGTAGGCATACTTTGCATAATGTCTGATAGAGACCTTTATGACAAGTTGCAATTTAC

AAGTCTTGAAATTCCACGTAGGAATGTGGCAACTTTACAAGCTGAAAATGTAACAGGACTCTTTAAAGATTGTAGTAAGGT

AATCACTGGGTTACATCCTACACAGGCACCTACACACCTCAGTGTTGACACTAAATTCAAAACTGAAGGTTTATGTGTTGAC

ATACCTGGCATACCTAAGGACATGACCTATAGAAGACTCATCTCTATGATGGGTTTTAAAATGAATTATCAAGTTAATGGTT
```

| SEQUENCES |
|---|
| ACCCTAACATGTTTATCACCCGCGAAGAAGCTATAAGACATGTACGTGCATGGATTGGCTTCGATGTCGAGGGGTGTCATG |
| CTACTAGAGAAGCTGTTGGTACCAATTTACCTTTACAGCTAGGTTTTTCTACAGGTGTTAACCTAGTTGCTGTACCTACAGG |
| TTATGTTGATACACCTAATAATACAGATTTTTCCAGAGTTAGTGCTAAACCACCGCCTGGAGATCAATTTAAACACCTCATA |
| CCACTTATGTACAAAGGACTTCCTTGGAATGTAGTGCGTATAAAGATTGTACAAATGTTAAGTGACACACTTAAAAATCTCT |
| CTGACAGAGTCGTATTTGTCTTATGGGCACATGGCTTTGAGTTGACATCTATGAAGTATTTTGTGAAAATAGGACCTGAGC |
| GCACCTGTTGTCTATGTGATAGACGTGCCACATGCTTTTCCACTGCTTCAGACACTTATGCCTGTTGGCATCATTCTATTGGA |
| TTTGATTACGTCTATAATCCGTTTATGATTGATGTTCAACAATGGGGTTTTACAGGTAACCTACAAAGCAACCATGATCTGT |
| ATTGTCAAGTCCATGGTAATGCACATGTAGCTAGTTGTGATGCAATCATGACTAGGTGTCTAGCTGTCCACGAGTGCTTTG |
| TTAAGCGTGTTGACTGGACTATTGAATATCCTATAATTGGTGATGAACTGAAGATTAATGCGGCTTGTAGAAAGGTTCAAC |
| ACATGGTTGTTAAAGCTGCATTATTAGCAGACAAATTCCCAGTTCTTCACGACATTGGTAACCCTAAAGCTATTAAGTGTGT |
| ACCTCAAGCTGATGTAGGATGGAAGTTCTATGATGCACAGCCTTGTAGTGACAAAGCTTATAAAATAGAAGAATTATTCTA |
| TTCTTATGCCACACATTCTGACAAATTCACAGATGGTGTATGCCTATTTTGGAATTGCAATGTCGATAGATATCCTGCTAATT |
| CCATTGTTTGTAGATTTGACACTAGAGTGCTATCTAACCTTAACTTGCCTGGTTGTGATGGTGGCAGTTTGTATGTAAATAA |
| ACATGCATTCCACACACCAGCTTTTGATAAAAGTGCTTTTGTTAATTTAAAACAATTACCATTTTTCTATTACTCTGACAGTCC |
| ATGTGAGTCTCATGGAAAACAAGTAGTGTCAGATATAGATTATGTACCACTAAAGTCTGCTACGTGTATAACACGTTGCAA |
| TTTAGGTGGTGCTGTCTGTAGACATCATGCTAATGAGTACAGATTGTATCTCGATGCTTATAACATGATGATCTCAGCTGGC |
| TTTAGCTTGTGGGTTTACAAACAATTTGATACTTATAACCTCTGGAACACTTTTACAAGACTTCAGAGTTTAGAAAATGTGG |
| CTTTTAATGTTGTAAATAAGGGACACTTTGATGGACAACAGGGTGAAGTACCAGTTTCTATCATTAATAACACTGTTTACAC |
| AAAAGTTGATGGTGTTGATGTAGAATTGTTTGAAAATAAAACAACATTACCTGTTAATGTAGCATTTGAGCTTTGGGCTAA |
| GCGCAACATTAAACCAGTACCAGAGGTGAAAATACTCAATAATTTGGGTGTGGATATTGCTGCTAATACTGTGATCTGGGA |
| CTACAAAAGAGATGCTCCAGCACATATATCTACTATTGGTGTTTGTTCTATGACTGACATAGCCAAGAAACCAACTGAAAC |
| GATTTGTGCACCACTCACTGTCTTTTTTGATGGTAGAGTTGATGGTCAAGTAGACTTATTTAGAAATGCCCGTAATGGTGTT |
| CTTATTACAGAAGGTAGTGTTAAAGGTTTACAACCATCTGTAGGTCCCAAACAAGCTAGTCTTAATGGAGTCACATTAATT |
| GGAGAAGCCGTAAAAACACAGTTCAATTATTATAAGAAAGTTGATGGTGTTGTCCAACAATTACCTGAAACTTACTTTACTC |
| AGAGTAGAAATTTACAAGAATTTAAACCCAGGAGTCAAATGGAAATTGATTTCTTAGAATTAGCTATGGATGAATTCATTG |
| AACGGTATAAATTAGAAGGCTATGCCTTCGAACATATCGTTTATGGAGATTTTAGTCATAGTCAGTTAGGTGGTTTACATCT |
| ACTGATTGGACTAGCTAAACGTTTTAAGGAATCACCTTTTGAATTAGAAGATTTTATTCCTATGGACAGTACAGTTAAAAAC |
| TATTTCATAACAGATGCGCAAACAGGTTCATCTAAGTGTGTGTGTTCTGTTATTGATTTATTACTTGATGATTTTGTTGAAAT |
| AATAAAATCCCAAGATTTATCTGTAGTTTCTAAGGTTGTCAAAGTGACTATTGACTATACAGAAATTTCATTTATGCTTTGTG |
| TAAAGATGGCCATGTAGAAACATTTTACCCAAAATTACAATCTAGTCAAGCGTGGCAACCGGGTGTTGCTATGCCTAATCT |
| TTACAAAATGCAAAGAATGCTATTAGAAAAGTGTGACCTTCAAAATTATGGTGATAGTGCAACATTACCTAAAGGCATAAT |
| GATGAATGTCGCAAAATATACTCAACTGTGTCAATATTTAAACACATTAACATTAGCTGTACCCTATAATATGAGAGTTATA |
| CATTTTGGTGCTGGTTCTGATAAAGGAGTTGCACCAGGTACAGCTGTTTTAAGACAGTGGTTGCCTACGGGTACGCTGCTT |
| GTCGATTCAGATCTTAATGACTTTGTCTCTGATGCAGATTCAACTTTGATTGGTGATTGTGCAACTGTACATACAGCTAATA |
| AATGGGATCTCATTATTAGTGATATGTACGACCCTAAGACTAAAAATGTTACAAAAGAAAATGACTCTAAAGAGGGTTTTT |
| TCACTTACATTTGTGGGTTTATACAACAAAAGCTAGCTCTTGGAGGTTCCGTGGCTATAAAGATAACAGAACATTCTTGGA |
| ATGCTGATCTTTATAAGCTCATGGGACACTTCGCATGGTGGACAGCCTTTGTTACTAATGTGAATGCGTCATCATCTGAAGC |
| ATTTTTAATTGGATGTAATTATCTTGGCAAACCACGCGAACAAATAGATGGTTATGTCATGCATGCAAATTACATATTTTGG |
| AGGAATACAAATCCAATTCAGTTGTCTTCCTATTCTTTATTTGACATGAGTAAATTTCCCCTTAAATTAAGGGGTACTGCTGT |

| SEQUENCES |
|---|
| TATGTCTTTAAAAGAAGGTCAAATCAATGATATGATTTTATCTCTTCTTAGTAAAGGTAGACTTATAATTAGAGAAAACAAC |
| AGAGTTGTTATTTCTAGTGATGTTCTTGTTAACAACTAAACGAACAATGTTTGTTTTTCTTGTTTTATTGCCACTAGTCTCTAG |
| TCAGTGTGTTAATCTTACAACCAGAACTCAATTACCCCCTGCATACACTAATTCTTTCACACGTGGTGTTTATTACCCTGACA |
| AAGTTTTCAGATCCTCAGTTTTACATTCAACTCAGGACTTGTTCTTACCTTTCTTTTCCAATGTTACTTGGTTCCATGCTATCT |
| CTGGGACCAATGGTACTAAGAGGTTTGATAACCCTGTCCTACCATTTAATGATGGTGTTTATTTTGCTTCCACTGAGAAGTC |
| TAACATAATAAGAGGCTGGATTTTTGGTACTACTTTAGATTCGAAGACCCAGTCCCTACTTATTGTTAATAACGCTACTAAT |
| GTTGTTATTAAAGTCTGTGAATTTCAATTTTGTAATGATCCATTTTTGGGTGTTTACCACAAAAACAACAAAAGTTGGATGG |
| AAAGTGAGTTCAGAGTTTATTCTAGTGCGAATAATTGCACTTTTGAATATGTCTCTCAGCCTTTTCTTATGGACCTTGAAGG |
| AAAACAGGGTAATTTCAAAAATCTTAGGGAATTTGTGTTTAAGAATATTGATGGTTATTTTAAAATATATTCTAAGCACACG |
| CCTATTAATTTAGTGCGTGATCTCCCTCAGGGTTTTTCGGCTTTAGAACCATTGGTAGATTTGCCAATAGGTATTAACATCAC |
| TAGGTTTCAAACTTTACTTGCTTTACATAGAAGTTATTTGACTCCTGGTGATTCTTCTTCAGGTTGGACAGCTGGTGCTGCA |
| GCTTATTATGTGGGTTATCTTCAACCTAGGACTTTTCTATTAAAATATAATGAAATGGAACCATTACAGATGCTGTAGACT |
| GTGCACTTGACCCTCTCTCAGAAACAAAGTGTACGTTGAAATCCTTCACTGTAGAAAAAGGAATCTATCAAACTTCTAACTT |
| TAGAGTCCAACCAACAGAATCTATTGTTAGATTTCCTAATATTACAAACTTGTGCCCTTTTGGTGAAGTTTTTAACGCCACCA |
| GATTTGCATCTGTTTATGCTTGGAACAGGAAGAGAATCAGCAACTGTGTTGCTGATTATTCTGTCCTATATAATTCCGCATC |
| ATTTTCCACTTTTAAGTGTTATGGAGTGTCTCCTACTAAATTAAATGATCTCTGCTTTACTAATGTCTATGCAGATTCATTTGT |
| AATTAGAGGTGATGAAGTCAGACAAATCGCTCCAGGGCAAACTGGAAAGATTGCTGATTATAATTATAAATTACCAGATG |
| ATTTTACAGGCTGCGTTATAGCTTGGAATTCTAACAATCTTGATTCTAAGGTTGGTGGTAATTATAATTACCTGTATAGATT |
| GTTTAGGAAGTCTAATCTCAAACCTTTTGAGAGAGATATTTCAACTGAAATCTATCAGGCCGGTAGCACACCTTGTAATGG |
| TGTTGAAGGTTTTAATTGTTACTTTCCTTTACAATCATATGGTTTCCAACCCACTTATGGTGTTGGTTACCAACCATACAGAG |
| TAGTAGTACTTTCTTTTGAACTTCTACATGCACCAGCAACTGTTTGTGGACCTAAAAAGTCTACTAATTTGGTTAAAAACAA |
| ATGTGTCAATTTCAACTTCAATGGTTTAACAGGCACAGGTGTTCTTACTGAGTCTAACAAAAAGTTTCTGCCTTTCCAACAA |
| TTTGGCAGAGACATTGATGACACTACTGATGCTGTCCGTGATCCACAGACACTTGAGATTCTTGACATTACACCATGTTCTT |
| TTGGTGGTGTCAGTGTTATAACACCAGGAACAAATACTTCTAACCAGGTTGCTGTTCTTTATCAGGGTGTTAACTGCACAG |
| AAGTCCCTGTTGCTATTCATGCAGATCAACTTACTCCTACTTGGCGTGTTTATTCTACAGGTTCTAATGTTTTTCAAACACGT |
| GCAGGCTGTTTAATAGGGGCTGAACATGTCAACAACTCATATGAGTGTGACATACCCATTGGTGCAGGTATATGCGCTAGT |
| TATCAGACTCAGACTAATTCTCATCGGCGGGCACGTAGTGTAGCTAGTCAATCCATCATTGCCTACACTATGTCACTTGGTG |
| CAGAAAATTCAGTTGCTTACTCTAATAACTCTATTGCCATACCCATAAATTTTACTATTAGTGTTACCACAGAAATTCTACCA |
| GTGTCTATGACCAAGACATCAGTAGATTGTACAATGTACATTTGTGGTGATTCAACTGAATGCAGCAATCTTTTGTTGCAAT |
| ATGGCAGTTTTTGTACACAATTAAACCGTGCTTTAACTGGAATAGCTGTTGAACAAGACAAAAACACCCAAGAAGTTTTTG |
| CACAAGTCAAACAAATTTACAAAACACCACCAATTAAAGATTTTGGTGGTTTTAATTTTTCACAAATATTACCAGATCCATCA |
| AAACCAAGCAAGAGGTCATTTATTGAAGATCTACTTTTCAACAAAGTGACACTTGCAGATGCTGGCTTCATCAAACAATAT |
| GGTGATTGCCTTGGTGATATTGCTGCTAGAGACCTCATTTGTGCACAAAAGTTTAACGGCCTTACTGTTTTGCCACCTTTGC |
| TCACAGATGAAATGATTGCTCAATACACTTCTGCACTGTTAGCGGGTACAATCACTTCTGGTTGGACCTTTGGTGCAGGTG |
| CTGCATTACAAATACCATTTGCTATGCAAATGGCTTATAGGTTTAATGGTATTGGAGTTACACAGAATGTTCTCTATGAGAA |
| CCAAAAATTGATTGCCAACCAATTTAATAGTGCTATTGGCAAAATTCAAGACTCACTTTCTTCCACAGCAAGTGCACTTGGA |
| AAACTTCAAGATGTGGTCAACCAAAATGCACAAGCTTTAAACACGCTTGTTAAACAACTTAGCTCCAATTTTGGTGCAATTT |
| CAAGTGTTTTAAATGATATCCTTGCACGTCTTGACAAAGTTGAGGCTGAAGTGCAAATTGATAGGTTGATCACAGGCAGAC |

| SEQUENCES |
|---|
| TTCAAAGTTTGCAGACATATGTGACTCAACAATTAATTAGAGCTGCAGAAATCAGAGCTTCTGCTAATCTTGCTGCTACTAA |
| AATGTCAGAGTGTGTACTTGGACAATCAAAAAGAGTTGATTTTTGTGGAAAGGGCTATCATCTTATGTCCTTCCCTCAGTCA |
| GCACCTCATGGTGTAGTCTTCTTGCATGTGACTTATGTCCCTGCACAAGAAAAGAACTTCACAACTGCTCCTGCCATTTGTC |
| ATGATGGAAAAGCACACTTTCCTCGTGAAGGTGTCTTTGTTTCAAATGGCACACACTGGTTTGTAACACAAAGGAATTTTTA |
| TGAACCACAAATCATTACTACACACAACACATTTGTGTCTGGTAACTGTGATGTTGTAATAGGAATTGTCAACAACACAGTT |
| TATGATCCTTTGCAACCTGAATTAGACTCATTCAAGGAGGAGTTAGATAAATATTTTAAGAATCATACATCACCAGATGTTG |
| ATTTAGGTGACATCTCTGGCATTAATGCTTCAGTTGTAAACATTCAAAAAGAAATTGACCGCCTCAATGAGGTTGCCAAGA |
| ATTTAAATGAATCTCTCATCGATCTCCAAGAACTTGGAAAGTATGAGCAGTATATAAAATGGCCATGGTACATTTGGCTAG |
| GTTTTATAGCTGGCTTGATTGCCATAGTAATGGTGACAATTATGCTTTGCTGTATGACCAGTTGCTGTAGTTGTCTCAAGGG |
| CTGTTGTTCTTGTGGATCCTGCTGCAAATTTGATGAAGACGACTCTGAGCCAGTGCTCAAAGGAGTCAAATTACATTACAC |
| ATAAACGAACTTATGGATTTGTTTATGAGAATCTTCACAATTGGAACTGTAACTTTGAAGCAAGGTGAAATCAAGGATGCT |
| ACTCCTTCAGATTTTGTTCGCGCTACTGCAACGATACCGATACAAGCCTCACTCCCTTTCGGATGGCTTATTGTTGGCGTTGC |
| ACTTCTTGCTGTTTTTCAGAGCGCTTCCAAAATCATAACCCTCAAAAAGAGATGGCAACTAGCACTCTCCAAGGGTGTTCAC |
| TTTGTTTGCAACTTGCTGTTGTTGTTTGTAACAGTTTACTCACACCTTTTGCTCGTTGCTGCTGGCCTTGAAGCCCCTTTTCTC |
| TATCTTTATGCTTTAGTCTACTTCTTGCAGAGTATAAACTTTGTAAGAATAATAATGAGGCTTTGGCTTTGCTGGAAATGCC |
| GTTCCAAAAACCCATTACTTTATGATGCCAACTATTTTCTTTGCTGGCATACTAATTGTTACGACTATTGTATACCTTACAATA |
| GTGTAACTTCTTCAATTGTCATTACTTCAGGTGATGGCACAACAAGTCCTATTTCTGAACATGACTACCAGATTGGTGGTTA |
| TACTGAAAAATGGGAATCTGGAGTAAAAGACTGTGTTGTATTACACAGTTACTTCACTTCAGACTATTACCAGCTGTACTCA |
| ACTCAATTGAGTACAGACACTGGTGTTGAACATGTTACCTTCTTCATCTACAATAAAATTGTTGATGAGCCTGAAGAACATG |
| TCCAAATTCACACAATCGACGGTTCATCCGGAGTTGTTAATCCAGTAATGGAACCAATTTATGATGAACCGACGACGACTA |
| CTAGCGTGCCTTTGTAAGCACAAGCTGATGAGTACGAACTTATGTACTCATTCGTTTCGGAAGAGACAGGTACGTTAATAG |
| TTAATAGCGTACTTCTTTTTCTTGCTTTCGTGGTATTCTTGCTAGTTACACTAGCCATCCTTACTGCGCTTCGATTGTGTGCGT |
| ACTGCTGCAATATTGTTAACGTGAGTCTTGTAAAACCTTCTTTTTACGTTTACTCTCGTGTTAAAAATCTGAATTCTTCTAGA |
| GTTCCTGATCTTCTGGTCTAAACGAACTAAATATTATATTAGTTTTTCTGTTTGGAACTTTAATTTTAGCCATGGCAGATTCC |
| AACGGTACTATTACCGTTGAAGAGCTTAAAAAGCTCCTTGAACAATGGAACCTAGTAATAGGTTTCCTATTCCTTACATGGA |
| TTTGTCTTCTACAATTTGCCTATGCCAACAGGAATAGGTTTTTGTATATAATTAAGTTAATTTTCCTCTGGCTGTTATGGCCA |
| GTAACTTTAGCTTGTTTTGTGCTTGCTGCTGTTTACAGAATAAATTGGATCACCGGTGGAATTGCTATCGCAATGGCTTGTC |
| TTGTAGGCTTGATGTGGCTCAGCTACTTCATTGCTTCTTTCAGACTGTTTGCGCGTACGCGTTCCATGTGGTCATTCAATCCA |
| GAAACTAACATTCTTCTCAACGTGCCACTCCATGGCACTATTCTGACCAGACCGCTTCTAGAAAGTGAACTCGTAATCGGAG |
| CTGTGATCCTTCGTGGACATCTTCGTATTGCTGGACACCATCTAGGACGCTGTGACATCAAGGACCTGCCTAAAGAAATCA |
| CTGTTGCTACATCACGAACGCTTTCTTATTACAAATTGGGAGCTTCGCAGCGTGTAGCAGGTGACTCAGGTTTTGCTGCAT |
| ACAGTCGCTACAGGATTGGCAACTATAAATTAAACACAGACCATTCCAGTAGCAGTGACAATATTGCTTTGCTTGTACAGT |
| AAGTGACAACAGATGTTTCATCTCGTTGACTTTCAGGTTACTATAGCAGAGATATTACTAATTATTATGAGGACTTTTAAAG |
| TTTCCATTTGGAATCTTGATTACATCATAAACCTCATAATTAAAAATTTATCTAAGTCACTAACTGAGAATAAATATTCTCAA |
| TTAGATGAAGAGCAACCAATGGAGATTGATTAAACGAACATGAAAATTATTCTTTTCTTGGCACTGATAACACTCGCTACTT |
| GTGAGCTTTATCACTACCAAGAGTGTGTTAGAGGTACAACAGTACTTTTAAAAGAACCTTGCTCTTCTGGAACATACGAGG |
| GCAATTCACCATTTCATCCTCAGCTGATAACAAATTTGCACTGACTTGCTTTAGCACTCAATTTGCTTTTGCTTGTCCTGAC |
| GGCGTAAAACACGTCTATCAGTTACGTGCCAGATCAGTTTCACCTAAACTGTTCATCAGACAAGAGGAAGTTCAAGAACTT |
| TACTCTCCAATTTTTCTTATTGTTGCGGCAATAGTGTTTATAACACTTTGCTTCACACTCAAAAGAAAGACAGAATGATTGAA |

| SEQUENCES |
|---|
| CTTTCATTAATTGACTTCTATTTGTGCTTTTTAGCCTTTCTGCTATTCCTTGTTTTAATTATGCTTATTATCTTTTGGTTCTCACT
TGAACTGCAAGATCATAATGAAACTTGTCACGCCTAAACGAACATGAAATTTCTTGTTTTCTTAGGAATCATCACAACTGTA
GCTGCATTTCACCAAGAATGTAGTTTACAGTCATGTACTTAACATCAACCATATGTAGTTGATGACCCGTGTCCTATTCACTT
CTATTCTAAATGGTATATTAGAGTAGGAGCTATAAAATCAGCACCTTTAATTGAATTGTGCGTGGATGAGGCTGGTTCTAA
ATCACCCATTCAGTGCATCGATATCGGTAATTATACAGTTTCCTGTTTACCTTTTACAATTAATTGCCAGGAACCTAAATTGG
GTAGTCTTGTAGTGCGTTGTTCGTTCTATGAAGACTTTTTAGAGTATCATGACGTTCGTGTTGTTTTAGATTTCATCTAAACG
AACAAACTAAATGTCTCTAAATGGACCCCAAAATCAGCGAAATGCACCCCGCATTACGTTTGGTGGACCCTCAGATTCAAC
TGGCAGTAACCAGAATGGAGAACGCAGTGGGGCGCGATCAAAACAACGTCGGCCCCAAGGTTTACCCAATAATACTGCGT
CTGGTTCACCGCTCTCACTCAACATGGCAAGGAAGACCTTAAATTCCCTCGAGGACAAGGCGTTCCAATTAACACCAATA
GCAGTCCAGATGACCAAATTGGCTACTACCGAAGAGCTACCAGACGAATTCGTGGTGGTGACGGTAAAATGAAAGATCTC
AGTCCAAGATGGTATTTCTACTACCTAGGAACTGGGCCAGAAGCTGGACTTCCCTATGGTGCTAACAAAGACGGCATCATA
TGGGTTGCAACTGAGGGAGCCTTGAATACACCAAAAGATCACATTGGCACCCGCAATCCTGCTAACAATGCTGCAATCGTG

CTACAACTTCCTCAAGGAACAACATTGCCAAAAGGCTTCTACGCAGAAGGGAGCAGAGGCGGCAGTCAAGCCTCTTCTCG

TTCCTCATCACGTAGTCGCAACAGTTCAAGAAATTCAACTCCAGGCAGCAGTAAACGAACTTCTCCTGCTAGAATGGCTGG

CAATGGCGGTGATGCTGCTCTTGCTTTGCTGCTGCTTGACAGATTGAACCAGCTTGAGAGCAAAATGTTTGGTAAAGGCCA

ACAACAACAAGGCCAAACTGTCACTAAGAAATCTGCTGCTGAGGCTTCTAAGAAGCCTCGGCAAAAACGTACTGCCACTA

AAGCATACAATGTAACACAAGCTTTCGGCAGACGTGGTCCAGAACAAACCCAAGGAAATTTTGGGGACCAGGAACTAATC

AGACAAGGAACTGATTACAAACATTGGCCGCAAATTGCACAATTTGCCCCCAGCGCTTCAGCGTTCTTCGGAATGTCGCGC

ATTGGCATGGAAGTCACACCTTCGGGAACGTGGTTGACCTACACAGGTGCCATCAAATTGGATGACAAAGATCCAAATTTC

AAAGATCAAGTCATTTTGCTGAATAAGCATATTGACGCATACAAAACATTCCCACCAACAGAGCCTAAAAAGGACAAAAAG

AAGAAGGCTGATGAAACTCAAGCCTTACCGCAGAGACAGAAGAAACAGCAAACTGTGACTCTTCTTCCTGCTGCAGATTT

GGATGATTTCTCCAAACAATTGCAACAATCCATGAGCAGTGCTGACTCAACTCAGGCCTAAACTCATGCAGACCACACAAG

GCAGATGGGCTATATAAACGTTTTCGCTTTTCCGTTTACGATATATAGTCTACTCTTGTGCAGAATGAATTCTCGTAACTACA

TAGCACAAGTAGATGTAGTTAACTTTAATCTCACATAGCAATCTTTAATCAGTGTGTAACATTAGGGAGGACTTGAAAGAG

CCACCACATTTTCACCGAGGCCACGCGGAGTACGATCGAGTGTACAGTGAACAATGCTAGGGAGAGCTGCCTATATGGAA

GAGCCCTAATGTGTAAAATTAATTTTAGTAGTGCTATCCCCATGTGATTTTAATAGCTTCTTAGGAGAATGNNNNNNNNN

NNNNNNNNNNNNNNNNNNNNNNNNN

>MIG457_gp02 QQH18545.1 surface glycoprotein, from UK_MIG457genome accession MW422256

SEQ ID NO: 23

MFVFLVLLPLVSSQCVNLTTRTQLPPAYTNSFTRGVYYPDKVFRSSVLHSTQDLFLPFFSNVTWFHAISGTNGTKRFDNPVLPFN

DGVYFASTEKSNIIRGWIFGTTLDSKTQSLLIVNNATNVVIKVCEFQFCNDPFLGVYHKNNKSWMESEFRVYSSANNCTFEYVSQ

PFLMDLEGKQGNFKNLREFVFKNIDGYFKIYSKHTPINLVRDLPQGFSALEPLVDLPIGINITRFQTLLALHRSYLTPGDSSSGWTA

GAAAYYVGYLQPRTFLLKYNENGTITDAVDCALDPLSETKCTLKSFTVEKGIYQTSNFRVQPTESIVRFPNITNLCPFGEVFNATRF

ASVYAWNRKRISNCVADYSVLYNSASFSTFKCYGVSPTKLNDLCFTNVYADSFVIRGDEVRQIAPGQTGKIADYNYKLPDDFTGC

VIAWNSNNLDSKVGGNYNYLYRLFRKSNLKPFERDISTEIYQAGSTPCNGVEGFNCYFPLQSYGFQPTYGVGYQPYRVVVLSFEL

LHAPATVCGPKKSTNLVKNKCVNFNFNGLTGTGVLTESNKKFLPFQQFGRDIDDTTDAVRDPQTLEILDITPCSFGGVSVITPGT

NTSNQVAVLYQGVNCTEVPVAIHADQLTPTWRVYSTGSNVFQTRAGCLIGAEHVNNSYECDIPIGAGICASYQTQTNSHRRAR

SVASQSIIAYTMSLGAENSVAYSNNSIAIPINFTISVTTEILPVSMTKTSVDCTMYICGDSTECSNLLLQYGSFCTQLNRALTGIAVE

QDKNTQEVFAQVKQIYKTPPIKDFGGFNFSQILPDPSKPSKRSFIEDLLFNKVTLADAGFIKQYGDCLGDIAARDLICAQKFNGLTV

| SEQUENCES |
|---|
| LPPLLTDEMIAQYTSALLAGTITSGWTFGAGAALQIPFAMQMAYRFNGIGVTQNVLYENQKLIANQFNSAIGKIQDSLSSTASAL |
| GKLQDVVNQNAQALNTLVKQLSSNFGAISSVLNDILARLDKVEAEVQIDRLITGRLQSLQTYVTQQLIRAAEIRASANLAATKMS |
| ECVLGQSKRVDFCGKGYHLMSFPQSAPHGVVFLHVTYVPAQEKNFTTAPAICHDGKAHFPREGVFVSNGTHWFVTQRNFYEP |
| QIITTHNTFVSGNCDVVIGIVNNTVYDPLQPELDSFKEELDKYFKNHTSPDVDLGDISGINASVVNIQKEIDRLNEVAKNLNESLID |
| LQELGKYEQYIKWPWYIWLGFIAGLIAIVMVTIMLCCMTSCCSCLKGCCSCGSCCKFDEDDSEPVLKGVKLHYT |
| >MW493681.1 Severe acute respiratory syndrome coronavirus 2 isolate SARS-CoV-2/human/USA/ NMDOH-2021013232/2021, complete genome. [Severe acute respiratory syndrome coronavirus 2 (SARS-CoV-2)], Californian B.1.427 lineage     SEQ ID NO: 24 |
| AAGGTTTATACCTTCCCAGGTAACAAACCAACCAACTTTCGATCTCTTGTAGATCTGTTCTCTAAACGAACTTTAAAATCTGT |
| GTGGCTGTCACTCGGCTGCATGCTTAGTGCACTCACGCAGTATAATTAATAACTAATTACTGTCGTTGACAGGACACGAGT |
| AACTCGTCTATCTTCTGCAGGCTGCTTACGGTTTCGTCCGTGTTGCAGCCGATCATCAGCACATCTAGGTTTTGTCCGGGTG |
| TGACCGAAAGGTAAGATGGAGAGCCTTGTCCCTGGTTTCAACGAGAAAACACACGTCCAACTCAGTTTGCCTGTTTTACAG |
| GTTCGCGACGTGCTCGTACGTGGCTTTGGAGACTCCGTGGAGGAGGTCTTATCAGAGGCACGTCAACATCTTAAAGATGG |
| CACTTGTGGCTTAGTAGAAGTTGAAAAAGGCGTTTTGCCTCAACTTGAACAGCCCTATGTGTTCATCAAACGTTCGGATGC |
| TCGAACTGCACCTCATGGTCATGTTATGGTTGAGCTGGTAGCAGAACTCGAAGGCATTCAGTACGGTCGTAGTGGTGAGA |
| CACTTGGTGTCCTTGTCCCTCATGTGGGCGAAATACCAGTGGCTTACCGCAAGGTTCTTCTTCGTAAGAACGGTAATAAAG |
| GAGCTGGTGGCCATAGTTACGCGCCGATCTAAAGTCATTTGACTTAGGCGACGAGCTTGGCACTGATCCTTATGAAGATT |
| TTCAAGAAAACTGGAACACTAAACATAGCAGTGGTGTTACCCGTGAACTCATGCGTGAGCTTAACGGAGGGGCATACACT |
| CGCTATGTCGATAACAACTTCTGTGGCCCTGATGGCTACCCTCTTGAGTGCATTAAAGACCTTCTAGCACGTGCTGGTAAA |
| GCTTCATGCACTTTGTCCGAACAACTGGACTTTATTGACACTAAGAGGGGTGTATACTGCTGCCGTGAACATGAGCATGAA |
| ATTGCTTGGTACACGGAACGTTCTGAAAAGAGCTATGAATTGCAGACACCTTTTGAAATTAAATTGGCAAAGAAATTT |
| GACATCTTCAATGGGGAATGTCCAAATTTTGTATTTCCCTTAAATTCCATAATCAAGACTATTCAACCAAGGGTTGAAAAGA |
| AAAAGCTTGATGGCTTTATGGGTAGAATTCGATCTGTCTATCCAGTTGCGTCACCAAATGAATGCAACCAAATGTGCCTTTC |
| AACTCTCATGAAGTGTGATCATTGTGGTGAAACTTCATGGCAGACGGGCGATTTTGTTAAAGCCACTTGCGAATTTTGTGG |
| CACTGAGAATTTGACTAAAGAAGGTGCCACTACTTGTGGTTACTTACCCCAAAATGCTGTTGTTAAAATTTATTGTCCAGCA |
| TGTCACAATTCAGAAGTAGGACCTGAGCATAGTCTTGCCGAATACCATAATGAATCTGGCTTGAAAACCATTCTTCGTAAG |
| GGTGGTCGCACTATTGCCTTTGGAGGCTGTGTGTTCTCTTATGTTGGTTGCCATAACAAGTGTGCCTATTGGGTTCCACGTG |
| CTAGCGCTAACATAGGTTGTAACCATACAGGTGTTGTTGGAGAAGGTTCCGAAGGTCTTAATGACAACCTTCTTGAAATAC |
| TCCAAAAAGAGAAAGTCAACATCAATATTGTTGGTGACTTTAAACTTAATGAAGAGATCGCCATTATTTGGCATCTTTTTC |
| TGCTTCCACAAGTGCTTTTGTGGAAACTGTGAAAGGTTTGGATTATAAAGCATTCAAACAAATTGTTGAATCCTGTGGTAAT |
| TTTAAAGTTACAAAAGGAAAAGCTAAAAAGGTGCCTGGAATATTGGTGAACAGAAATCAATACTGAGTCCTCTTTATGCA |
| TTTGCATCAGAGGCTGCTCGTGTTGTACGATCAATTTTCTCCCGCACTCTTGAAACTGCTCAAAATTCTGTGCGTGTTTTACA |
| GAAGGCCGCTATAACAATACTAGATGGAATTTCACAGTATTCACTGAGACTCATTGATGCTATGATGTTCACATCTGATTT |
| GGCTACTAACAATCTAGTTGTAATGGCCTACATTACAGGTGGTGTTGTTCAGTTGACTTCGCAGTGGCTAACTAACATCTTT |
| GGCACTGTTTATGAAAAACTCAAACCCGTCCTTGATTGGCTTGAAGAGAAGTTTAAGGAAGGTGTAGAGTTTCTTAGAGAC |
| GGTTGGGAAATTGTTAAATTTATCTCAACCTGTGCTTGTGAAATTGTCGGTGGACAAATTGTCACCTGTGCAAAGGAAATT |
| AAGGAGAGTGTTCAGACATTCTTTAAGCTTGTAAATAAATTTTTGGCTTTGTGTGCTGACTCTATCATTATTGGTGGAGCTA |
| AACTTAAAGCCTTGAATTTAGGTGAAACATTTGTCACGCACTCAAAGGGATTGTACAGAAAGTGTGTTAAATCCAGAGAAG |
| AAACTGGCCTACTCATGCCTCTAAAAGCCCCAAAAGAAATTATCTTCTTAGAGGGAGAAACACTTCCCACAGAAGTGTTAA |
| CAGAGGAAGTTGTCTTGAAAACTGGTGATTTACAACCATTAGAACAACCTACTAGTGAAGCTGTTGAAGCTCCATTGGTTG |

-continued

SEQUENCES

GTACACCAGTTTGTATTAACGGGCTTATGTTGCTCGAAATCAAAGACACAGAAAAGTACTGTGCCCTTGCACCTAATATGA

TGGTAACAAACAATACCTTCACACTCAAAGGCGGTGCACCAACAAAGGTTACTTTTGGTGATGACACTGTGATAGAAGTGC

AAGGTTACAAGAGTGTGAATATCACTTTTGAACTTGATGAAAGGATTGATAAAGTACTTAATGAGAAGTGCTCTGCCTATA

CAGTTGAACTCGGTACAGAAGTAAATGAGTTCGCCTGTGTTGTGGCAGATGCTGTCATAAAAACTTTGCAACCAGTATCTG

AATTACTTACACCACTGGGCATTGATTTAGATGAGTGGAGTATGGCTACATACTACTTATTTGATGAGTCTGGTGAGTTTAA

ATTGGCTTCACATATGTATTGTTCTTTTTACCCTCCAGATGAGGATGAAGAAGAAGGTGATTGTGAAGAAGAAGAGTTTGA

GCCATCAACTCAATATGAGTATGGTACTGAAGATGATTACCAAGGTAAACCTTTGGAATTTGGTGCCACTTCTGCTGCTCTT

CAACCTGAAGAAGAGCAAGAAGAAGATTGGTTAGATGATGATAGTCAACAAACTGTTGGTCAACAAGACGGCAGTGAGG

ACAATCAGACAACTACTATTCAAACAATTGTTGAGGTTCAACCTCAATTAGAGATGGAACTTACACCAGTTGTTCAGACTAT

TGAAGTGAATAGTTTTAGTGGTTATTTAAAACTTACTGACAATGTATACATTAAAAATGCAGACATTGTGGAAGAAGCTAA

AAAGGTAAAACCAACAGTGGTTGTTAATGCAGCCAATGTTTACCTTAAACATGGAGGAGGTGTTGCAGGAGCCTTAAATA

AGGCTACTAACAATGCCATGCAAGTTGAATCTGATGATTACATAGCTACTAATGGACCACTTAAAGTGGGTGGTAGTTGT

GTTTTAAGCGGACACAATCTTGCTAAACACTGTCTTCATGTTGTCGGCCCAAATGTTAACAAAGGTGAAGACATTCAACTTC

TTAAGAGTGCTTATGAAAATTTTAATCAGCACGAAGTTCTACTTGCACCATTATTATCAGCTGGTATTTTTGGTGCTGACCCT

ATACATTCTTTAAGAGTTTGTGTAGATACTGTTCGCACAAATGTCTACTTAGCTGTCTTTGATAAAAATCTCTATGACAAACT

TGTTTCAAGCTTTTTGGAAATGAAGAGTGAAAAGCAAGTTGAACAAAAGATCGCTGAGATTCCTAAAGAGGAAGTTAAGC

CATTTATAACTGAAAGTAAACCTTCAGTTGAACAGAGAAAACAAGATGATAAGAAAATCAAAGCTTGTGTTGAAGAAGTT

ACAACAACTCTGGAAGAAACTAAGTTCCTCACAGAAAACTTGTTACTTTATATTGACATTAATGGCAATCTTCATCCAGATT

CTGCCACTCTTGTTAGTGACATTGACATCACTTTCTTAAAGAAAGATGCTCCATATATAGTGGGTGATGTTGTTCAAGAGGG

TGTTTTAACTGCTGTGGTTATACCTACTAAAAAGGCTGGTGGCACTACTGAAATGCTAGCGAAAGCTTTGAGAAAAGTGCC

AACAGACAATTATATAACCACTTACCCGGGTCAGGGTTTAAATGGTTACACTGTAGAGGAGGCAAAGACAGTGCTTAAAA

AGTGTAAAAGTGCCTTTTACATTCTACCATCTATTATCTCTAATGAGAAGCAAGAAATTCTTGGAACTGTTTCTTGGAATTTG

CGAGAAATGCTTGCACATGCAGAAGAAACACGCAAATTAATGCCTGTCTGTGTGGAAACTAAAGCCATAGTTTCAACTATA

CAGCGTAAATATAAGGGTATTAAAATACAAGAGGGTGTGGTTGATTATGGTGCTAGATTTTACTTTTACACCAGTAAAACA

ACTGTAGCGTCACTTATCAACACACTTAACGATCTAAATGAAACTCTTGTTACAATGCCACTTGGCTATGTAACACATGGCT

TAAATTTGGAAGAAGCTGCTCGGTATATGAGATCTCTCAAAGTGCCAGCTACAGTTTCTGTTTCTTCACCTGATGCTGTTAC

AGCGTATAATGGTTATCTTACTTCTTCTTCTAAAACACCTGAAGAACATTTTATTGAAACCATCTCACTTGCTGGTTCCTATA

AAGATTGGTCCTATTCTGGACAATCTACACAACTAGGTATAGAATTTCTTAAGAGAGGTGATAAAAGTGTATATTACACTA

GTAATCCTACCACATTCCACCTAGATGGTGAAGTTATCACCTTTGACAATCTTAAGACACTTCTTTCTTTGAGAGAAGTGAG

GACTATTAAGGTGTTTACAACAGTAGACAACATTAACCTCCACACGCAAGTTGTGGACATGTCAATGACATATGGACAACA

GTTTGGTCCAACTTATTTGGATGGAGCTGATGTTACTAAAATAAAACCTCATAATTCACATGAAGGTAAAACATTTTATGTT

TTACCTAATGATGACACTCTACGTGTTGAGGCTTTTGAGTACTACCACACAACTGATCCTAGTTTTCTGGGTAGGTACATGT

CAGCATTAAATCACACTAAAAAGTGGAAATACCCACAAGTTAATGGTTTAACTTCTATTAAATGGGCAGATAACAACTGTT

ATCTTGCCACTGCATTGTTAACACTCCAACAAATAGAGTTGAAGTTTAATCCACCTGCTCTACAAGATGCTTATTACAGAGC

AAGGGCTGGTGAAGCTGCTAACTTTTGTGCACTTATCTTAGCCTACTGTAATAAGACAGTAGGTGAGTTAGGTGATGTTAG

AGAAACAATGAGTTACTTGTTTCAACATGCCAATTTAGATTCTTGCAAAAGAGTCTTGAACGTGGTGTGTAAAACTTGTGG

ACAACAGCAGACAACCCTTAAGGGTGTAGAAGCTGTTATGTACATGGGCACACTTTCTTATGAACAATTTAAGAAAGGTGT

TCAGATACCTTGTACGTGTGGTAAACAAGCTACAAAATATCTAGTACAACAGGAGTCACCTTTTGTTATGATGTCAGCACCA

| SEQUENCES |
|---|
| CCTGCTCAGTATGAACTTAAGCATGGTACATTTACTTGTGCTAGTGAGTACACTGGTAATTACCAGTGTGGTCACTATAAAC |
| ATATAACTTCTAAAGAAACTTTGTATTGCATAGACGGTGCTTTACTTACAAAGTCCTCAGAATACAAAGGTCCTATTACGGA |
| TGTTTTCTACAAAGAAAACAGTTACACAACAACCATAAAACCAGTTACTTATAAATTGGATGGTGTTGTTTGTACAGAAATT |
| GACCCTAAGTTGGACAATTATTATAAGAAAGACAATTCTTATTTCACAGAGCAACCAATTGATCTTGTACCAACCAACCAT |
| ATCCAAACGCAAGCTTCGATAATTTTAAGTTTGTATGTGATAATATCAAATTTGCTGATGATTTAAACCAGTTAACTGGTTA |
| TAAGAAACCTGCTTCAAGAGAGCTTAAAGTTACATTTTTCCCTGACTTAAATGGTGATGTGGTGGCTATTGATTATAAACAC |
| TACACACCCTCTTTTAAGAAAGGAGCTAAATTGTTACATAAACCTATTGTTTGGCATGTTAACAATGCAACTAATAAAGCCA |
| CGTATAAACCAAATACCTGGTGTATACGTTGTCTTTGGAGCACAAAACCAGTTGAAACATCAAATTCGTTTGATGTACTGAA |
| GTCAGAGGACGCGCAGGGAATGGATAATCTTGTCTGCGAAGATCTAAAACCAGTCTCTGAAGAAGTAGTGGAAAATCCTA |
| CCATACAGAAAGACGTTCTTGAGTGTAATGTGAAAACTACCGAAGTTGTAGGAGACATTATACTTAAACCAGCAAATAATA |
| GTTTAAAAATTACAGAAGAGGTTGGCCACACAGATCTAATGGCTGCTTATGTAGACAATTCTAGTCTTACTATTAAGAAAC |
| CTAATGAATTATCTAGAGTATTAGGTTTGAAAACCCTTGCTACTCATGGTTTAGCTGCTGTTAATAGTGTCCCTTGGGATAC |
| TATAGCTAATTATGCTAAGCCTTTTCTTAACAAAGTTGTTAGTACAACTACTAACATAGTTACACGGTGTTTAAACCGTGTTT |
| GTACTAATTATATGCCTTATTTCTTTACTTTATTGCTACAATTGTGTACTTTTACTAGAAGTACAAATTCTAGAATTAAAGCAT |
| CTATGCCGACTACTATAGCAAAGAATACTGTTAAGAGTGTCGGTAAATTTTGTCTAGAGGCTTCATTTAATTATTTGAAGTC |
| ACCTAATTTTTCTAAACTGATAAATATTATAATTTGGTTTTTACTATTAAGTGTTTGCCTAGGTTCTTTAATCTACTCAACCGC |
| TGCTTTAGGTGTTTTAATGTCTAATTTAGGCATGCCTTCTTACTGTACTGGTTACAGAGAAGGCTATTTGAACTCTACTAATG |
| TCACTATTGCAACCTACTGTACTGGTTCTATACCTTGTAGTGTTTGTCTTAGTGGTTTAGATTCTTTAGACACCTATCCTTCTT |
| TAGAAACTATACAAATTACCATTTCATCTTTTAAATGGGATTTAACTGCTTTTGGCTTAGTTGCAGAGTGGTTTTTGGCATAT |
| ATTCTTTTCACTAGGTTTTTCTATGTACTTGGATTGGCTGCAATCATGCAATTGTTTTTCAGCTATTTTGCAGTACATTTTATT |
| AGTAATTCTTGGCTTATGTGGTTAATAATTAATCTTGTACAAATGGCCCCGATTTCAGCTATGGTTAGAATGTACATCTTCT |
| TTGCATCATTTTATTATGTATGGAAAAGTTATGTGCATGTTGTAGACGGTTGTAATTCATCAACTTGTATGATGTGTTACAA |
| ACGTAATAGAGCAACAAGAGTCGAATGTACAACTATTGTTAATGGTGTTAGAAGGTCCTTTTATGTCTATGCTAATGGAGG |
| TAAAGGCTTTTGCAAACTACACAATTGGAATTGTGTTAATTGTGATACATTCTGTGCTGGTAGTACATTTATTAGTGATGAA |
| GTTGCGAGAGACTTGTCACTACAGTTTAAAAGACCAATAAATCCTACTGACCAGTCTTCTTACATCGTTGATAGTGTTACAG |
| TGAAGAATGGTTCCATCCATCTTTACTTTGATAAAGCTGGTCAAAAGACTTATGAAAGACATTCTCTCTCTCATTTTGTTAAC |
| TTAGACAACCTGAGAGCTAATAACACTAAAGGTTCATTGCCTATTAATGTTATAGTTTTTGATGGTAAATCAAAATGTGAAG |
| AATCATCTGCAAAATCAGCGTCTGTTTACTACAGTCAGCTTATGTGTCAACCTATACTGTTACTAGATCAGGCATTAGTGTC |
| TGATGTTGGTGATAGTGCGGAAGTTGCAGTTAAAATGTTTGATGCTTACGTTAATACGTTTTCATCAACTTTTAACGTACCA |
| ATGGAAAAACTCAAAACACTAGTTGCAACTGCAGAAGCTGAACTTGCAAAGAATGTGTCCTTAGACAATGTCTTATCTACT |
| TTTATTTCAGCAGCTCGGCAAGGGTTTGTTGATTCAGATGTAGAAACTAAAGATGTTGTTGAATGTCTTAAATTGTCACATC |
| AATCTGACATAGAAGTTACTGGCGATAGTGTAATAACTATATGCTCACCTATAACAAAGTTGAAAACATGACACCCCGTG |
| ACCTTGGTGCTTGTATTGACTGTAGTGCGCGTCATATTAATGCGCAGGTAGCAAAAAGTCACAACATTGCTTTGATATGGA |
| ACGTTAAAGATTTCATGTCATTGTCTGAACAACTACGAAAACAAATACGTAGTGCTGCTAAAAAGAATAACTTACCTTTTAA |
| GTTGACATGTGCAACTACTAGACAAGTTGTTAATGTTGTAACAACAAAGATAGCACTTAAGGGTGGTAAAATTGTTAATAA |
| TTGGTTGAAGCAGTTAATTAAAGTTACACTTGTGTTCCTTTTTGTTGCTGCTATTTTCTATTTAATAACACCTGTTCATGTCAT |
| GTCTAAACATACTGACTTTTCAAGTGAAATCATAGGATACAAGGCTATTGATGGTGGTGTCACTCGTGACATAGCATCTAC |
| AGATACTTGTTTTGCTAACAAACATGCTGATTTTGACACATGGTTTAGCCAGCGTGGTGGTAGTTATACTAATGACAAAGCT |
| TGCCCATTGATTGCTGCAGTCATAACAAGAGAAGTGGGTTTTGTCGTGCCTGGTTTGCCTGGCACGATATTACGCACAACT |

```
AATGGTGACTTTTTGCATTTCTTACCTAGAGTTTTTAGTGCAGTTGGTAACATCTGTTACACACCATCAAAACTTATAGAGTA
CACTGACTTTGCAACATCAGCTTGTGTTTTGGCTGCTGAATGTACAATTTTTAAAGATGCTTCTGGTAAGCCAGTACCATAT
TGTTATGATACCAATGTACTAGAAGGTTCTGTTGCTTATGAAAGTTTACGCCCTGACACACGTTATGTGCTCATGGATGGCT
CTATTATTCAATTTCCTAACACCTACCTTGAAGGTTCTGTTAGAGTGGTAACAACTTTTGATTCTGAGTACTGTAGGCACGG
CACTTGTGAAAGATCAGAAGCTGGTGTTTGTATCTACTAGTGGTAGATGGGTACTTAACAATGATTATTACAGATCTTTA
CCAGGAGTTTTCTGTGGTGTAGATGCTGTAAATTTACTTACTAATATGTTTACACCACTAATTCAACCTATTGGTGCTTTGGA
CATATCAGCATCTATAGTAGCTGGTGGTATTGTAGCTATCGTAGTAACATGCCTTGCCTACTATTTTATGAGGTTTAGAAGA
GCTTTTGGTGAATACAGTCATGTAGTTGCCTTTAATACTTTACTATTCCTTATGTCATTCACTGTACTCTGTTTAACACCAGTT
TACTCATTCTTACCTGGTGTTTATTCTGTTATTTACTTGTACTTGACATTTTATCTTACTAATGATGTTTCTTTTTTAGCACATA
TTCAGTGGATGGTTATGTTCACACCTTTAGTACCTTTCTGGATAACAATTGCTTATATCATTTGTATTTCCACAAAGCATTTCT
ATTGGTTCTTTACTAATTACCTAAAGAGACGTGTAGTCTTTAATGGTGTTTCCTTTAGTACTTTTGAAGAAGCTGCGCTGTG
CACCTTTTTGTTAAATAAAGAAATGTATCTAAAGTTGCGTAGTGATGTGCTATTACCTCTTACGCAATATAATAGATACTTA
GCTCTTTATAATAAGTACAAGTATTTTAGTGGAGCAATGGATACAACTAGCTACAGAGAAGCTGCTTGTTGTCATCTCGCA
AAGGCTCTCAATGACTTCAGTAACTCAGGTTCTGATGTTCTTTACCAACCACCACAAACCTCTATCACCTCAGCTGTTTTGCA
GAGTGGTTTTAGAAAAATGGCATTCCCATCTGGTAAAGTTGAGGGTTGTATGGTACAAGTAACTTGTGGTACAACTACACT
TAACGGTCTTTGGCTTGATGACGTAGTTTACTGTCCAAGACATGTGATCTGCACCTCTGAAGACATGCTTAACCCTAATTAT
GAAGATTACTCATTCGTAAGTCTAATCATAATTTCTTGGTACAGGCTGGTAATGTTCAACTCAGGGTTATTGGACATTCTA
TGCAAAATTGTGTACTTAAGCTTAAGGTTGATACAGCCAATCCTAAGACACCTAAGTATAAGTTTGTTCGCATTCAACCAGG
ACAGACTTTTTCAGTGTTAGCTTGTTACAATGGTTCACCATCTGGTGTTTACCAATGTGCTATGAGGCCCAATTTCACTATTA
AGGGTTCATTCCTTAATGGTTCATGTGGTAGTGTTGGTTTTAACATAGATTATGACTGTGTCTCTTTTTGTTACATGCACCAT
ATGGAATTACCAACTGGAGTTCATGCTGGCACAGACTTAGAAGGTAACTTTTATGGACCTTTTGTTGACAGGCAAACAGCA
CAAGCAGCTGGTACGGACACAACTATTACAGTTAATGTTTTAGCTTGGTTGTACGCTGCTGTTATAAATGGAGACAGGTGG
TTTCTCAATCGATTTACCACAACTCTTAATGACTTTAACCTTGTGGCTATGAAGTACAATTATGAACCTCTAACACAAGACCA
TGTTGACATACTAGGACCTCTTTCTGCTCAAACTGGAATTGCCGTTTTAGATATGTGTGCTTCATTAAAAGAATTACTGCAA
AATGGTATGAATGGACGTACCATATTGGGTAGTGCTTTATTAGAAGATGAATTTACACCTTTTGATGTTGTTAGACAATGCT
CAGGTGTTACTTTCCAAAGTGCAGTGAAAAGAACAATCAAGGGTACACACCACTGGTTGTTACTCACAATTTTGACTTCACT
TTTAGTTTTAGTCCAGAGTACTCAATGGTCTTTGTTCTTTTTTTGTATGAAAATGCCTTTTTACCTTTTGCTATGGGTATTAT
TGCTATGTCTGCTTTTGCAATGATGTTTGTCAAACATAAGCATGCATTTCTCTGTTTGTTTTTGTTACCTTCTCTTGCCACTG
TAGCTTATTTTAATATGGTCTATATGCCTGCTAGTTGGGTGATGCGTATTATGACATGGTTGGATATGGTTGATACTAGTTT
GTCTGGTTTTAAGCTAAAAGACTGTGTTATGTATGCATCAGCTGTAGTGTTACTAATCCTTATGACAGCAAGAACTGTGTAT
GATGATGGTGCTAGGAGAGTGTGGACACTTATGAATGTCTTGACACTCGTTTATAAAGTTTATTATGGTAATGCTTTAGAT
CAAGCCATTTCCATGTGGGCTCTTATAATCTCTGTTACTTCTAACTACTCAGGTGTAGTTACAACTGTCATGTTTTTGGCCAA
AGGTATTGTTTTTATGTGTGTTGAGTATTGCCCTATTTTCTTCATAACTGGTAATACACTTCAGTGTATAATGCTAGTTTATT
GTTTCTTAGGCTATTTTTGTACTTGTTACTTTGGCCTCTTTTGTTTACTCAACCGCTACTTTAGACTGACTCTTGGTGTTTATG
ATTACTTAGTTTCTACACAGGAGTTTAGATATATGAATTCACAGGGACTACTCCCACCCAAGAATAGCATAGATGCCTTCAA
ACTCAACATTAAATTGTTGGGTGTTGGTGGCAAACCTTGTATCAAAGTAGCCACTGTACAGTCTAAAATGTCAGATGTAAA
GTGCACATCAGTAGTCTTACTCTCAGTTTTGCAACAACTCAGAGTAGAATCATCATCTAAATTGTGGGCTCAATGTGTCCAG
TTACACAATGACATTCTCTTAGCTAAAGATACTACTGAAGCCTTTGAAAAAATGGTTTCACTACTTTCTGTTTTGCTTTCCAT
```

-continued

| SEQUENCES |
|---|
| GCAGGGTGCTGTAGACATAAACAAGCTTTGTGAAGAAATGCTGGACAACAGGGCAACCTTACAAGCTATAGCCTCAGAGT |
| TTAGTTCCCTTCCATCATATGCAGCTTTTGCTACTGCTCAAGAAGCTTATGAGCAGGCTGTTGCTAATGGTGATTCTGAAGT |
| TGTTCTTAAAAAGTTGAAGAAGTCTTTGAATGTGGCTAAATCTGAATTTGACCGTGATGCAGCCATGCAACGTAAGTTGGA |
| AAAGATGGCTGATCAAGCTATGACCCAAATGTATAAACAGGCTAGATCTGAGGACAAGAGGGCAAAAGTTACTAGTGCTA |
| TGCAGACAATGCTTTTCACTATGCTTAGAAAGTTGGATAATGATGCACTCAACAACATTATCAACAATGCAAGAGATGGTT |
| GTGTTCCCTTGAACATAATACCTCTTACAACAGCAGCCAAATTAATGGTTGTCATACCAGACTATAACACATATAAAAATAC |
| GTGTGATGGTACAACATTTACTTATGCATCAGCATTGTGGGAAATCCAACAGGTTGTAGATGCAGATAGTAAAATTGTTCA |
| ACTTAGTGAAATTAGTATGGACAATTCACCTAATTTAGCATGGCCTCTTATTGTAACAGCTTTAAGGGCCAATTCTGCTGTC |
| AAATTACAGAATAATGAGCTTAGTCCTGTTGCACTACGACAGATGTCTTGTGCTGCCGGTACTACACAAACTGCTTGCACT |
| GATGACAATGCGTTAGCTTACTACAACACAACAAAGGGAGGTAGGTTTGTACTTGCACTGTTATCCGATTTACAGGATTTG |
| AAATGGGCTAGATTCCCTAAGAGTGATGGAACTGGTACTATCTATACAGAACTGGAACCACCTTGTAGGTTTGTTACAGAC |
| ACACCTAAAGGTCCTAAAGTGAAGTATTTATACTTTATTAAAGGATTAAACAACCTAATAGAGGTATGGTACTTGGTAGT |
| TTAGCTGCCACAGTACGTCTACAAGCTGGTAATGCAACAGAAGTGCCTGCCAATTCAACTGTATTATCTTTCTGTGCTTTTG |
| CTGTAGATGCTGCTAAAGCTTACAAAGATTATCTAGCTAGTGGGGACAACCAATCACTAATTGTGTTAAGATGTTGTGTA |
| CACACACTGGTACTGGTCAGGCAATAACAGTTACACCGGAAGCCAATATGGATCAAGAATCCTTTGGTGGTGCATCGTGTT |
| GTCTGTACTGCCGTTGCCACATAGATCATCCAAATCCTAAAGGATTTTGTGACTTAAAAGGTAAGTATGTACAAATACCTAC |
| AACTTGTGCTAATGACCCTGTGGGTTTTACACTTAAAAACACAGTCTGTACCGTCTGCGGTATGTGGAAAGGTTATGGCTG |
| TAGTTGTGATCAACTCCGCGAACCCATGCTTCAGTCAGCTGATGCACAATCGTTTTTAAACGGGTTTGCGGTGTAAGTGCA |
| GCCCGTCTTACACCGTGCGGCACAGGCACTAGTACTGATGTCGTATACAGGGCTTTTGACATCTACAATGATAAAGTAGCT |
| GGTTTTGCTAAATTCCTAAAAACTAATTGTTGTCGCTTCCAAGAAAAGGACGAAGATGACAATTTAATTGATTCTTACTTTG |
| TAGTTAAGAGACACACTTTCTCTAACTACCAACATGAAGAAACAATTTATAATTTACTTAAAGATTGTCCAGCTGTTGCTAA |
| ACATGACTTCTTTAAGTTTAGAATAGACGGTGACATGGTACCACATATATCACGTCAACGTCTTACTAAATACACAATGGCA |
| GACCTCGTCTATGCTTTAAGGCATTTTGATGAAGGTAATTGTGACACATTAAAAGAAATACTTGTCACATACAATTGTTGTG |
| ATGATGATTATTTCAATAAAAAGGACTGGTATGATTTTGTAGAAAACCCAGATATATTACGCGTATACGCCAACTTAGGTG |
| AACGTGTACGCCAAGCTTTGTTAAAAACAGTACAATTCTGTGATGCCATGCGAAATGCTGGTATTGTTGGTGTACTGACAT |
| TAGATAATCAAGATCTCAATGGTAACTGGTATGATTTCGGTGATTTCATACAAACCACGCCAGGTAGTGGAGTTCCTGTTG |
| TAGATTCTTATTATTCATTGTTAATGCCTATATTAACCTTGACCAGGGCTTTAACTGCAGAGTCACATGTTGACACTGACTTA |
| ACAAAGCCTTACATTAAGTGGGATTTGTTAAAATATGACTTCACGGAAGAGAGGTTAAAACTCTTTGACCGTTATTTTAAAT |
| ATTGGGATCAGACATACCACCCAAATTGTGTTAACTGTTTGGATGACAGATGCATTCTGCATTGTGCAAACTTTAATGTTTT |
| ATTCTCTACAGTGTTCCCACTTACAAGTTTTGGACCACTAGTGAGAAAAATATTTGTTGATGGTGTTCCATTTGTAGTTTCAA |
| CTGGATACCACTTCAGAGAGCTAGGTGTTGTACATAATCAGGATGTAAACTTACATAGCTCTAGACTTAGTTTTAAGGAAT |
| TACTTGTGTATGCTGCTGACCCTGCTATGCACGCTGCTTCTGGTAATCTATTACTAGATAAACGCACTACGTGCTTTTCAGTA |
| GCTGCACTTACTAACAATGTTGCTTTTCAAACTGTCAAACCCGGTAATTTTAACAAAGACTTCTATGACTTTGCTGTGTCTAA |
| GGGTTTCTTTAAGGAAGGAAGTTCTGTTGAATTAAAACACTTCTTCTTTGCTCAGGATGGTAATGCTGCTATCAGCGATTAT |
| GACTACTATCGTTATAATCTACCAACAATGTGTGATATCAGACAACTACTATTTGTAGTTGAAGTTGTTGATAAGTACTTTG |
| ATTGTTACGATGGTGGCTGTATTAATGCTAACCAAGTCATCGTCAACAACCTAGACAAATCAGCTGGTTTTCCATTTAATAA |
| ATGGGGTAAGGCTAGACTTTATTATGATTCAATGAGTTATGAGGATCAAGATGCACTTTTCGCATATACAAAACGTAATGT |
| CATCCCTACTATAACTCAAATGAATCTTAAGTATGCCATTAGTGCAAAGAATAGAGCTCGCACCGTAGCTGGTGTCTCTATC |
| TGTAGTACTATGACCAATAGACAGTTTCATCAAAAATTATTGAAATCAATAGCCGCCACTAGAGGAGCTACTGTAGTAATT |

| SEQUENCES |
|---|
| GGAACAAGCAAATTCTATGGTGGTTGGCACAACATGTTAAAAACTGTTTATAGTGATGTAGAAAACCCTCACCTTATGGGT |
| TGGGATTATCCTAAATGTGATAGAGCCATGCCTAACATGCTTAGAATTATGGCCTCACTTGTTCTTGCTCGCAAACATACAA |
| CGTGTTGTAGCTTGTCACACCGTTTCTATAGATTAGCTAATGAGTGTGCTCAAGTATTGAGTGAAATGGTCATGTGTGGCG |
| GTTCACTATATGTTAAACCAGGTGGAACCTCATCAGGAGATGCCACAACTGCTTATGCTAATAGTGTTTTTAACATTTGTCA |
| AGCTGTCACGGCCAATGTTAATGCACTTTTATCTACTGATGGTAACAAAATTGCCGATAAGTATGTCCGCAATTTACAACAC |
| AGACTTTATGAGTGTCTCTATAGAAATAGAGATGTTGACACAGACTTTGTGAATGAGTTTTACGCATATTTGCGTAAACATT |
| TCTCAATGATGATACTCTCTGACGATGCTGTTGTGTGTTTCAATAGCACTTATGCATCTCAAGGTCTAGTGGCTAGCATAAA |
| GAACTTTAAGTCAGTTCTTTATTATCAAAACAATGTTTTTATGTCTGAAGCAAAATGTTGGACTGAGACTGACCTTACTAAA |
| GGACCTCATGAATTTTGCTCTCAACATACAATGCTAGTTAAACAGGGTGATGATTATGTGTACCTTCCTTACCCAGATCCAT |
| CAAGAATCCTAGGGGCCGGCTGTTTTGTAGATGATATCGTAAAAACAGATGGTACACTTATGATTGAACGGTTCGTGTCTT |
| TAGCTATAGATGCTTACCCACTTACTAAACATCCTAATCAGGAGTATGCTGATGTCTTTCATTTGTACTTACAATACATAAGA |
| AAGCTACATGATGAGTTAACAGGACACATGTTAGACATGTATTCTGTTATGCTTACTAATGATAACACTTCAAGGTATTGG |
| GAACCTGAGTTTTATGAGGCTATGTACACACCGCATACAGTCTTACAGGCTGTTGGGGCTTGTGTTCTTTGCAATTCACAGA |
| CTTCATTAAGATGTGGTGCTTGCATACGTAGACCATTCTTATGTTGTAAATGCTGTTACGACCATGTCATATCAACATCACAT |
| AAATTAGTCTTGTCTGTTAATCCGTATGTTTGCAATGCTCTAGGTTGTGATGTCACAGATGTGACTCAACTTTACTTAGGAG |
| GTATGAGCTATTATTGTAAATCACATAAACCACCCATTAGTTTTCCATTGTGTGCTAATGGACAAGTTTTTGGTTTATATAAA |
| AATACATGTGTTGGTAGCGATAATGTTACTGACTTTAATGCAATTGCAACATGTGACTGGACAAATGCTGGTGATTACATTT |
| TAGCTAACACCTGTACTGAAAGACTCAAGCTTTTTGCAGCAGAAACGCTCAAAGCTACTGAGGAGACATTTAAACTGTCTT |
| ATGGTATTGCTACTGTACGTGAAGTGCTGTCTGACAGAGAATTACATCTTTCATGGGAAGTTGGTAAACCTAGACCACCAC |
| TTAACCGAAATTATGTCTTTACTGGTTATCGTGTAACTAAAAACAGTAAAGTACAAATAGGAGAGTACACCTTTGAAAAAG |
| GTGACTATGGTGATGCTGTTGTTTACCGAGGTACAACAACTTACAAATTAAATGTTGGTGATTATTTTGTGCTGACATCACA |
| TACAGTAATGCCATTAAGTGCACCTACACTAGTGCCACAAGAGCACTATGTTAGAATTACTGGCTTATACCCAACACTCAAT |
| ATCTCATATGAGTTTTCTAGCAATGTTGCAAATTATCAAAAGGTTGGTATGCAAAAGTATTCTACACTCCAGGGACCACCTG |
| GTACTGGTAAGAGTCATTTTGCTATTGGCCTAGCTCTCTACTACCCTTCTGCTCGCATAGTGTATACAGCTTGCTCTCATGCC |
| GCTGTTGATGCACTATGTGAGAAGGCATTAAAATATTTGCCTATAGATAAATGTAGTAGAATTATACCTGCACGTGCTCGT |
| GTAGAGTGTTTTGATAAATTCAAAGTGAATTCAACATTAGAACAGTATGTCTTTTGTACTGTAAATGCATTGCCTGAGACGA |
| CAGCAGATATAGTTGTCTTTGATGAAATTTCAATGGCCACAAATTATGATTTGAGTGTTGTCAATGCCAGATTACGTGCTAA |
| GCACTATGTGTACATTGGCGACCCTGCTCAATTACCTGCACCACGCACATTGCTAACTAAGGGCACACTAGAACCAGAATA |
| TTTCAATTCAGTGTGTAGACTTATGAAAACTATAGGTCCAGACATGTTCCTCGGAACTTGTCGGCGTTGTCCTGCTGAAATT |
| GTTGACACTGTGAGTGCTTTGGTTTATGATAATAAGCTTAAAGCACATAAAGACAAATCAGCTCAATGCTTTAAAATGTTTT |
| ATAAGGGTGTTATCACGCATGATGTTTCATCTGCAATTAACAGGCCACAAATAGGCGTGGTAAGAGAATTCCTTACACGTA |
| ACCCTGCTTGGAGAAAAGCTGTCTTTATTTCACCTTATAATTCACAGAATGCTGTAGCCTCAAAGATTTTGGGACTACCAAC |
| TCAAACTGTTGATTCATCACAGGGCTCAGAATATGACTATGTCATATTCACTCAAACCACTGAAACAGCTCACTCTTGTAAT |
| GTAAACAGATTTAATGTTGCTATTACCAGAGCAAAGTAGGCATACTTTGCATAATGTCTGATAGAGACCTTTATGACAAG |
| TTGCAATTTACAAGTCTTGAAATTCCACGTAGGAATGTGGCAACTTTACAAGCTGAAAATGTAACAGGACTCTTTAAAGATT |
| GTAGTAAGGTAATCACTGGGTTACATCCTACACAGGCACCTACACACCTCAGTGTTGACACTAAATTCAAAACTGAAGGTT |
| TATGTGTTGACATACCTGGCATACCTAAGGACATGACCTATAGAAGACTCATCTCTATGATGGGTTTTAAAATGAATTATCA |
| AGTTAATGGTTACCCTAACATGTTTATCACCCGCGAAGAAGCTATAAGACATGTACGTGCATGGATTGGCTTCGATGTCGA |

| SEQUENCES |
|---|
| GGGGTGTCATGCTACTAGAGAAGCTGTTGGTACCAATTTACCTTTACAGCTAGGTTTTTCTACAGGTGTTAACCTAGTTGCT |
| GTACCTACAGGTTATGTTGATACACCTAATAATACAGATTTTTCCAGAGTTAGTGCTAAACCACCGCCTGGAGATCAATTTA |
| AACACCTCATACCACTTATGTACAAAGGACTTCCTTGGAATGTAGTGCGTATAAAGATTGTACAAATGTTAAGTGACACACT |
| TAAAAATCTCTCTGACAGAGTCGTATTTGTCTTATGGGCACATGGCTTTGAGTTGACATCTATGAAGTATTTTGTGAAAATA |
| GGACCTGAGCGCACCTGTTGTCTATGTGATAGACGTGCCACATGCTTTTCCACTGCTTCAGACACTTATGCCTGTTGGCATC |
| ATTCTATTGGATTTGATTACGTCTATAATCCGTTTATGATTGATGTTCAACAATGGGGTTTTACAGGTAACCTACAAAGCAA |
| CCATGATCTGTATTGTCAAGTCCATGGTAATGCACATGTAGCTAGTTGTGATGCAATCATGACTAGGTGTCTAGCTGTCCAC |
| GAGTGCTTTGTTAAGCGTGTTGACTGGACTATTGAATATCCTATAATTGGTGATGAACTGAAGATTAATGCGGCTTGTAGA |
| AAGGTTCAACACATGGTTGTTAAAGCTGCATTATTAGCAGACAAATTCCCAGTTCTTCACGACATTGGTAACCCTAAAGCTA |
| TTAAGTGTGTACCTCAAGCTGATGTAGAATGGAAGTTCTATGATGCACAGCCTTGTAGTGACAAAGCTTATAAAATAGAAG |
| AATTATTCTATTCTTATGCCACACATTCTGACAAATTCACAGATGGTGTATGCCTATTTTGGAATTGCAATGTCGATAGATAT |
| CCTGCTAATTCCATTGTTTGTAGATTTGACACTAGAGTGCTATCTAACCTTAACTTGCCTGGTTGTGATGGTGGCAGTTTGT |
| ATGTAAATAAACATGCATTCCACACACCAGCTTTTGATAAAAGTGCTTTTGTTAATTTAAAACAATTACCATTTTTCTATTAC |
| TCTGACAGTCCATGTGAGTCTCATGGAAAACAAGTAGTGTCAGATATAGATTATGTACCACTAAAGTCTGCTACGTGTATA |
| ACACGTTGCAATTTAGGTGGTGCTGTCTGTAGACATCATGCTAATGAGTACAGATTGTATCTCGATGCTTATAACATGATG |
| ATCTCAGCTGGCTTTAGCTTGTGGGTTTACAAACAATTTGATACTTATAACCTCTGGAACACTTTTACAAGACTTCAGAGTTT |
| AGAAAATGTGGCTTTTAATGTTGTAAATAAGGGACACTTTGATGGACAACAGGGTGAAGTACCAGTTTCTATCATTAATAA |
| CACTGTTTACACAAAAGTTGATGGTGTTGATGTAGAATTGTTTGAAAATAAAACAACATTACCTGTTAATGTAGCATTTGAG |
| CTTTGGGCTAAGCGCAACATTAAACCAGTACCAGAGGTGAAAATACTCAATAATTTGGGTGTGGACATTGCTGCTAATACT |
| GTGATCTGGGACTACAAAAGAGATGCTCCAGCACATATATCTACTATTGGTGTTTGTTCTATGACTGACATAGCCAAGAAA |
| CCAACTGAAACGATTTGTGCACCACTCACTGTCTTTTTTGATGGTAGAGTTGATGGTCAAGTAGACTTATTTAGAAATGCCC |
| GTAATGGTGTTCTTATTACAGAAGGTAGTGTTAAAGGTTTACAACCATCTGTAGGTCCCAAACAAGCTAGTCTTAATGGAG |
| TCACATTAATTGGAGAAGCCGTAAAAACACAGTTCAATTATTATAAGAAAGTTGATGGTGTTGTCCAACAATTACCTGAAA |
| CTTACTTTACTCAGAGTAGAAATTTACAAGAATTTAAACCCAGGAGTCAAATGGAAATTGATTTCTTAGAATTAGCTATGGA |
| TGAATTCATTGAACGGTATAAATTAGAAGGCTATGCCTTCGAACATATCGTTTATGGAGATTTTAGTCATAGTCAGTTAGGT |
| GGTTTACATCTACTGATTGGACTAGCTAAACGTTTTAAGGAATCACCTTTTGAATTAGAAGATTTTATTCCTATGGACAGTA |
| CAGTTAAAAACTATTTCATAACAGATGCGCAAACAGGTTCATCTAAGTGTGTGTGTTCTGTTATTGATTTATTACTTGATGA |
| TTTTGTTGAAATAATAAAATCCCAAGATTTATCTGTAGTTTCTAAGGTTGTCAAAGTGACTATTGACTATACAGAAATTTCAT |
| TTATGCTTTGGTGTAAAGATGGCCATGTAGAAACATTTTACCCAAAATTACAATCTAGTCAAGCGTGGCAACCGGGTGTTG |
| CTATGCCTAATCTTTACAAAATGCAAAGAATGCTATTAGAAAAGTGTGACCTTCAAAATTATGGTGATAGTGCAACATTACC |
| TAAAGGCATAATGATGAATGTCGCAAAATATACTCAACTGTGTCAATATTTAAACACATTAACATTAGCTGTACCCTATAAT |
| ATGAGAGTTATACATTTTGGTGCTGGTTCTGATAAAGGAGTTGCACCAGGTACAGCTGTTTTAAGACAGTGGTTGCCTACG |
| GGTACGCTGCTTGTCGATTCAGATCTTAATGACTTTGTCTCTGATGCAGATTCAACTTTGATTGGTGATTGTGCAACTGTAC |
| ATACAGCTAATAAATGGGATCTCATTATTAGTGATATGTACGACCCTAAGACTAAAAATGTTACAAAAGAAAATGACTCTA |
| AAGAGGGTTTTTTCACTTACATTTGTGGGTTTATACAACAAAAGCTAGCTCTTGGAGGTTCCGTGGCTATAAAGATAACAG |
| AACATTCTTGGAATGCTGATCTTTATAAGCTCATGGGACACTTCGCATGGTGGACAGCCTTTGTTACTAATGTGAATGCGTC |
| ATCATCTGAAGCATTTTTAATTGGATGTAATTATCTTGGCAAACCACGCGAACAAATAGATGGTTATGTCATGCATGCAAAT |
| TACATATTTTGGAGGAATACAAATCCAATTCAGTTGTCTTCCTATTCTTTATTTGACATGAGTAAATTTCCCCTTAAATTAAG |
| GGGTACTGCTGTTATGTCTTTAAAAGAAGGTCAAATCAATGATATGATTTTATCTCTTCTTAGTAAAGGTAGACTTATAATT |

SEQUENCES

```
AGAGAAAACAACAGAGTTGTTATTTCTAGTGATGTTCTTGTTAACAACTAAACGAACAATGTTTGTTTTTCTTGTTTTATTGC

CACTAGTCTCTATTCAGTGTGTTAATCTTACAACCAGAACTCAATTACCCCCTGCATACACTAATTCTTTCACACGTGGTGTT

TATTACCCTGACAAAGTTTTCAGATCCTCAGTTTTACATTCAACTCAGGACTTGTTCTTACCTTTCTTTTCCAATGTTACTTGG

TTCCATGCTATACATGTCTCTGGGACCAATGGTACTAAGAGGTTTGATAACCCTGTCCTACCATTTAATGATGGTGTTTATTT

TGCTTCCACTGAGAAGTCTAACATAATAAGAGGCTGGATTTTTGGTACTACTTTAGATTCGAAGACCCAGTCCCTACTTATT

GTTAATAACGCTACTAATGTTGTTATTAAAGTCTGTGAATTTCAATTTTGTAATGATCCATTTTTGGGTGTTTATTACCACAA

AAACAACAAAAGTTGTATGGAAAGTGAGTTCAGAGTTTATTCTAGTGCGAATAATTGCACTTTTGAATATGTCTCTCAGCCT

TTTCTTATGGACCTTGAAGGAAAACAGGGTAATTTCAAAAATCTTAGGGAATTTGTGTTTAAGAATATTGATGGTTATTTTA

AAATATATTCTAAGCACACGCCTATTAATTTAGTGCGTGATCTCCCTCAGGGTTTTTCGGCTTTAGAACCATTGGTAGATTT

GCCAATAGGTATTAACATCACTAGGTTTCAAACTTTACTTGCTTTACATAGAAGTTATTTGACTCCTGGTGATTCTTCTTCAG

GTTGGACAGCTGGTGCTGCAGCTTATTATGTGGGTTATCTTCAACCTAGGACTTTTCTATTAAAATATAATGAAAATGGAAC

CATTACAGATGCTGTAGACTGTGCACTTGACCCTCTCTCAGAAACAAAGTGTACGTTGAAATCCTTCACTGTAGAAAAGG

AATCTATCAAACTTCTAACTTTAGAGTCCAACCAACAGAATCTATTGTTAGATTTCCTAATATTACAAACTTGTGCCCTTTTG

GTGAAGTTTTTAACGCCACCAGATTTGCATCTGTTTATGCTTGGAACAGGAAGAGAATCAGCAACTGTGTTGCTGATTATTC

TGTCCTATATAATTCCGCATCATTTTCCACTTTTAAGTGTTATGGAGTGTCTCCTACTAAATAAATGATCTCTGCTTTACTAA

TGTCTATGCAGATTCATTTGTAATTAGAGGTGATGAAGTCAGACAAATCGCTCCAGGGCAAACTGGAAAGATTGCTGATTA

TAATTATAAATTACCAGATGATTTTACAGGCTGCGTTATAGCTTGGAATTCTAACAATCTTGATTCTAAGGTTGGTGGTAAT

TATAATTACCGGTATAGATTGTTTAGGAAGTCTAATCTCAAACCTTTTGAGAGAGATATTTCAACTGAAATCTATCAGGCCG

GTAGCACACCTTGTAATGGTGTTGAAGGTTTTAATTGTTACTTTCCTTTACAATCATATGGTTTCCAACCCACTAATGGTGTT

GGTTACCAACCATACAGAGTAGTAGTACTTTCTTTTGAACTTCTACATGCACCAGCAACTGTTTGTGGACCTAAAAAGTCTA

CTAATTTGGTTAAAAACAAATGTGTCAATTTCAACTTCAATGGTTTAACAGGCACAGGTGTTCTTACTGAGTCTAACAAAAA

GTTTCTGCCTTTCCAACAATTTGGCAGAGACATTGCTGACACTACTGATGCTGTCCGTGATCCACAGACACTTGAGATTCTT

GACATTACACCATGTTCTTTTGGTGGTGTCAGTGTTATAACACCAGGAACAAATACTTCTAACCAGGTTGCTGTTCTTTATC

AGGGTGTTAACTGCACAGAAGTCCCTGTTGCTATTCATGCAGATCAACTTACTCCTACTTGGCGTGTTTATTCTACAGGTTC

TAATGTTTTTCAAACACGTGCAGGCTGTTTAATAGGGGCTGAACATGTCAACAACTCATATGAGTGTGACATACCCATTGG

TGCAGGTATATGCGCTAGTTATCAGACTCAGACTAATTCTCCTCGGCGGGCACGTAGTGTAGCTAGTCAATCCATCATTGC

CTACACTATGTCACTTGGTGCAGAAAATTCAGTTGCTTACTCTAATAACTCTATTGCCATACCCACAAATTTTACTATTAGTG

TTACCACAGAAATTCTACCAGTGTCTATGACCAAGACATCAGTAGATTGTACAATGTACATTTGTGGTGATTCAACTGAATG

CAGCAATCTTTTGTTGCAATATGGCAGTTTTTGTACACAATTAAACCGTGCTTTAACTGGAATAGCTGTTGAACAAGACAAA

AACACCCAAGAAGTTTTTGCACAAGTCAAACAATTTACAAAACACCACCAATTAAAGATTTTGGTGGTTTTAATTTTTCAC

AAATATTACCAGATCCATCAAAACCAAGCAAGAGGTCATTTATTGAAGATCTACTTTTCAACAAAGTGACACTTGCAGATG

CTGGCTTCATCAAACAATATGGTGATTGCCTTGGTGATATTGCTGCTAGAGACCTCATTTGTGCACAAAAGTTTAACGGCCT

TACTGTTTTGCCACCTTTGCTCACAGATGAAATGATTGCTCAATACACTTCTGCACTGTTAGCGGGTACAATCACTTCTGGTT

GGACCTTTGGTGCAGGTGCTGCATTACAAATACCATTTGCTATGCAAATGGCTTATAGGTTTAATGGTATTGGAGTTACAC

AGAATGTTCTCTATGAGAACCAAAAATTGATTGCCAACCAATTTAATAGTGCTATTGGCAAAATTCAAGACTCACTTTCTTC

CACAGCAAGTGCACTTGGAAAACTTCAAGATGTGGTCAACCAAAATGCACAAGCTTTAAACACGCTTGTTAAACAACTTAG

CTCCAATTTTGGTGCAATTTCAAGTGTTTTAAATGATATCCTTTCACGTCTTGACAAAGTTGAGGCTGAAGTGCAAATTGAT

AGGTTGATCACAGGCAGACTTCAAAGTTTGCAGACATATGTGACTCAACAATTAATTAGAGCTGCAGAAATCAGAGCTTCT
```

| SEQUENCES |
|---|
| GCTAATCTTGCTGCTACTAAAATGTCAGAGTGTGTACTTGGACAATCAAAAAGAGTTGATTTTTGTGGAAAGGGCTATCAT |
| CTTATGTCCTTCCCTCAGTCAGCACCTCATGGTGTAGTCTTCTTGCATGTGACTTATGTCCCTGCACAAGAAAAGAACTTCAC |
| AACTGCTCCTGCCATTTGTCATGATGGAAAAGCACACTTTCCTCGTGAAGGTGTCTTTGTTTCAAATGGCACACACTGGTTT |
| GTAACACAAAGGAATTTTTATGAACCACAAATCATTACTACAGACAACACATTTGTGTCTGGTAACTGTGATGTTGTAATAG |
| GAATTGTCAACAACACAGTTTATGATCCTTTGCAACCTGAATTAGACTCATTCAAGGAGGAGTTAGATAAATATTTTAAGAA |
| TCATACATCACCAGATGTTGATTTAGGTGACATCTCTGGCATTAATGCTTCAGTTGTAAACATTCAAAAAGAAATTGACCGC |
| CTCAATGAGGTTGCCAAGAATTTAAATGAATCTCTCATCGATCTCCAAGAACTTGGAAAGTATGAGCAGTATATAAAATGG |
| CCATGGTACATTTGGCTAGGTTTTATAGCTGGCTTGATTGCCATAGTAATGGTGACAATTATGCTTTGCTGTATGACCAGTT |
| GCTGTAGTTGTCTCAAGGGCTGTTGTTCTTGTGGATCCTGCTGCAAATTTGATGAAGACGACTCTGAGCCAGTGCTCAAAG |
| GAGTCAAATTACATTACACATAAACGAACTTATGGATTTGTTTATGAGAATCTTCACAATTGGAACTGTAACTTTGAAGCAA |
| GGTGAAATCAAGGATGCTACTCCTTCAGATTTTGTTCGCGCTACTGCAACGATACCGATACAAGCCTCACTCCCTTTCGGAT |
| GGCTTATTGTTGGCGTTGCACTTCTTGCTGTTTTTCATAGCGCTTCCAAAATCATAACCCTCAAAAAGAGATGGCAACTAGC |
| ACTCTCCAAGGGTGTTCACTTTGTTTGCAACTTGCTGTTGTTGTTTGTAACAGTTTACTCACACCTTTTGCTCGTTGCTGCTG |
| GCCTTGAAGCCCCTTTTCTCTATCTTTATGCTTTAGTCTACTTCTTGCAGAGTATAAACTTTGTAAGAATAATAATGAGGCTT |
| TGGCTTTGCTGGAAATGCCGTTCCAAAAACCCATTACTTTATGATGCCAACTATTTTCTTTGCTGGCATACTAATTGTTACGA |
| CTATTGTATACCTTACAATAGTGTAACTTCTTCAATTGTCATTACTTCAGGTGATGGCACAACAAGTCCTATTTCTGAACATG |
| ACTACCAGATTGGTGGTTATACTGAAAAATGGGAATCTGGAGTAAAAGACTGTGTTGTATTACACAGTTACTTCACTTCAG |
| ACTATTACCAGCTGTACTCAACTCAATTGAGTACAGACACTGGTGTTGAACATGTTACCTTCTTCATCTACAATAAAATTGTT |
| GATGAGCCTGAAGAACATGTCCAAATTCACACAATCGACGGTTCATCCGGAGTTGTTAATCCAGTAATGGAACCAATTTAT |
| GATGAACCGACGACGACTACTAGCGTGCCTTTGTAAGCACAAGCTGATGAGTACGAACTTATGTACTCATTCGTTTCGGAA |
| GAGACAGGTACGTTAATAGTTAATAGCGTACTTCTTTTTCTTGCTTTCGTGGTATTCTTGCTAGTTACACTAGCCATCCTTAC |
| TGCGCTTCGATTGTGTGCGTACTGCTGCAATATTGTTAACGTGAGTCTTGTAAAACCTTCTTTTTACGTTTACTCTCGTGTTA |
| AAAATCTGAATTCTTCTAGAGTTCCTGATCTTCTGGTCTAAACGAACTAAATATTATATTAGTTTTTCTGTTTGGAACTTTAAT |
| TTTAGCCATGGTAGATTCCAACGGTACTATTACCGTTGAAGAGCTTAAAAAGCTCCTTGAACAATGGAACCTAGTAATAGG |
| TTTCCTATTCCTTACATGGATTTGTCTTCTACAATTTGCCTATGCCAACAGGAATAGGTTTTTGTATATAATTAAGTTAATTTT |
| TCTCTGGCTGTTATGGCCAGTAACTTTAGCTTGTTTTGTGCTTGCTGCTGTTTACAGAATAAATTGGATCACCGGTGGAATT |
| GCTATCGCAATGGCTTGTCTTGTAGGCTTGATGTGGCTCAGCTACTTCATTGCTTCTTTCAGACTGTTTGCGCGTACGCGTT |
| CCATGTGGTCATTCAATCCAGAAACTAACATTCTTCTCAACGTGCCACTCCATGGCACTATTCTGACCAGACCGCTTCTAGA |
| AAGTGAACTCGTAATCGGAGCTGTGATCCTTCGTGGACATCTTCGTATTGCTGGACACCATCTAGGACGCTGTGACATCAA |
| GGACCTGCCTAAAGAAATCACTGTTGCTACATCACGAACGCTTTCTTATTACAAATTGGGAGCTTCGCAGCGTGTAGCAGG |
| TGACTCAGGTTTTGCTGCATACAGTCGCTACAGGATTGGCAACTATAAATTAAACACAGACCATTCCAGTAGCAGTGACAA |
| TATTGCTTTGCTTGTACAGTAAGTGACAACAGATGTTTCATCTCGTTGACTTTCAGGTTACTATAGCAGAGATATTACTAATT |
| ATTATGAGGACTTTTAAAGTTTCCATTTGGAATCTTGATTACATCATAAACCTCATAATTAAAAATTTATCTAAGTCACTAAC |
| TGAGAATAAATATTCTCAATTAGATGAAGAGCAACCAATGGAGATTGATTAAACGAACATGAAAATTATTCTTTTCTTGGC |
| ACTGATAACACTCGCTACTTGTGAGCTTTATCACTACCAAGAGTGTGTTAGAGGTACAACAGTACTTTTAAAAGAACCTTGC |
| TCTTCTGGAACATACGAGGGCAATTCACCATTTCATCCTCTAGCTGATAACAAATTTGCACTGACTTGCTTTAGCACTCAATT |
| TGCTTTTGCTTGTCCTGACGGCGTAAAACACGTCTATCAGTTACGTGCCAGATCAGTTTCACCTAAACTGTTCATCAGACAA |
| GAGGAAGTTCAAGAACTTTACTCTCCAATTTTTCTTATTGTTGCGGCAATAGTGTTTATAACACTTTGCTTCACACTCAAAAG |
| AAAGACAGAATGATTGAACTTTCATTAATTGACTTCTATTTGTGCTTTTTAGCCTTTCTGCTATTCCTTGTTTTAATTATGCTT |

ATTATCTTTTGGTTCTCACTTGAACTGCAAGATCATAATGAAACTTGTCACGCCTAAACGAACATGAAATTTCTTGTTTTCTT
AGGAATCATCACAACTGTAGCTGCATTTCACCAAGAATGTAGTTTACAGTCATGTACTCAACATCAACCATATGTAGTTGAT
GACCCGTGTCCTATTCACTTCTATTCTAAATGGTATATTAGAGTAGGAGCTAGAAAATCAGCACCTTTAATTGAATTGTGCG
TGGATGAGGCTGGTTCTAAATCACCCATTCAGTACATCGATATCGGTAATTATACAGTTTCCTGTTTACCTTTTACAATTAAT
TGCCAGGAACCTAAATTGGGTAGTCTTGTAGTGCGTTGTTCGTTCTATGAAGACTTTTTAGAGTATCATGACGTTCGTGTTG
TTTTAGATTTCATCTAAACGAACAAACTATAATGTCTGATAATGGACCCCAAAATCAGCGAAATGCACCCCGCATTACGTTT
GGTGGACCCTCAGATTCAACTGGCAGTAACCAGAATGGAGAACGCAGTGGGGCGCGATCAAACAACGTCGGCCCCAAG
GTTTACCCAATAATACTGCGTCTTGGTTCACCGCTCTCACTCAACATGGCAAGGAAGACCTTAAATTCCCTCGAGGACAAG
GCGTTCCAATTAACACCAATAGCAGTCCAGATGACCAAATTGGCTACTACCAAGAGCTACCAGACGAATTCGTGGTGGT
GACGGTAAAATGAAAGATCTCAGTCCAAGATGGTATTTCTACTACCTAGGAACTGGGCCAGAAGCTGGACTTCCCTATGGT
GCTAACAAAGACGGCATCATATGGTTGCAACTGAGGGAGCCTTGAATACACCAAAAGATCACATTGGCACCCGCAATCC
TGCTAACAATGCTGCAATCGTGCTACAACTTCCTCAAGGAACAACATTGCCAAAAGGCTTCTACGCAGAAGGGAGCAGAG
GCGGCAGTCAAGCCTCTTCTCGTTCCTCATCACGTAGTCGCAACAGTTCAAGAAATTCAACTCCAGGCAGCAGTAGGGGAA
TTTCTCCTGCTAGAATGGCTGGCAATGGCGGTGATGCTGCTCTTGCTTTGCTGCTGCTTGACAGATTGAACCAGCTTGAGA
GCAAATGTCTGGTAAAGGCCAACAACAACAAGGCCAAACTGTCACTAAGAAATCTGCTGCTGAGGCTTCTAAGAAGCCT
CGGCAAAAACGTACTGCCACTAAAGCATACAATGTAACACAAGCTTTCGGCAGACGTGGTCCAGAACAAACCCAAGG
AAATTTTGGGGACCAGGAACTAATCAGACAAGGAACTGATTACAAACATTGGCCGCAAATTGCACAATTTGCCCCCAGCG
CTTCAGCGTTCTTCGGAATGTCGCGCATTGGCATGGAAGTCACACCTTCGGGAACGTGGTTGACCTACACAGGTGCCATCA
AATTGGATGACAAAGATCCAAATTTCAAAGATCAAGTCATTTTGCTGAATAAGCATATTGACGCATACAAAACATTTCCACC
AACAGAGCCTAAAAAGGACAAAAGAAGAAGGCTGATGAAACTCAAGCCTTACCGCAGAGACAGAAGAAACAGCAAACT
GTGACTCTTCTTCCTGCTGCAGATTTGGATGATTTCTCCAAACAATTGCAACAATCCATGAGCAGTGCTGACTCAACTCAGG
CCTAAACTCATGCAGACCACACAAGGCAGATGGGCTATATAAACGTTTTCGCTTTTCCGTTTACGATATATAGTCTACTCTT
GTGCAGAATGAATTCTCGTAACTACATAGCACAAGTAGATGTAGTTAACTTTAATCTCACATAGCAATCTTTAATCAGTGTG
TAACATTAGGGAGGACTTGAAAGAGCCACCACATTTTCACCGAGGCCACGCGGAGTACGATCGAGTGTACAGTGAACAAT
GCTAGGGAGAGCTGCCTATATGGAAGAGCCCTAATGTGTAAAATTAATTTTAGTAGTGCTATCC

>QQV21856.1: S surface protein

SEQ ID NO: 25

MFVFLVLLPLVSIQCVNLTTRTQLPPAYTNSFTRGVYYPDKVFRSSVLHSTQDLFLPFFSNVTWFHAIHVSGTNGTKRFDNPVLPF
NDGVYFASTEKSNIIRGWIFGTTLDSKTQSLLIVNNATNVVIKVCEFQFCNDPFLGVYYHKNNKSCMESEFRVYSSANNCTFEYVS
QPFLMDLEGKQGNFKNLREFVFKNIDGYFKIYSKHTPINLVRDLPQGFSALEPLVDLPIGINITRFQTLLALHRSYLTPGDSSSGWT
AGAAAYYVGYLQPRTFLLKYNENGTITDAVDCALDPLSETKCTLKSFTVEKGIYQTSNFRVQPTESIVRFPNITNLCPFGEVFNATR
FASVYAWNRKRISNCVADYSVLYNSASFSTFKCYGVSPTKLNDLCFTNVYADSFVIRGDEVRQIAPGQTGKIADYNYKLPDDFTG
CVIAWNSNNLDSKVGGNYNYRYRLFRKSNLKPFERDISTEIYQAGSTPCNGVEGFNCYFPLQSYGFQPTNGVGYQPYRVVVLSF
ELLHAPATVCGPKKSTNLVKNKCVNFNFNGLTGTGVLTESNKKFLPFQQFGRDIADTTDAVRDPQTLEILDITPCSFGGVSVITPG
TNTSNQVAVLYQGVNCTEVPVAIHADQLTPTWRVYSTGSNVFQTRAGCLIGAEHVNNSYECDIPIGAGICASYQTQTNSPRRAR
SVASQSIIAYTMSLGAENSVAYSNNSIAIPTNFTISVTTEILPVSMTKTSVDCTMYICGDSTECSNLLLQYGSFCTQLNRALTGIAVE
QDKNTQEVFAQVKQIYKTPPIKDFGGFNFSQILPDPSKPSKRSFIEDLLFNKVTLADAGFIKQYGDCLGDIAARDLICAQKFNGLTV
LPPLLTDEMIAQYTSALLAGTITSGWTFGAGAALQIPFAMQMAYRFNGIGVTQNVLYENQKLIANQFNSAIGKIQDSLSSTASAL
GKLQDVVNQNAQALNTLVKQLSSNFGAISSVLNDILSRLDKVEAEVQIDRLITGRLQSLQTYVTQQLIRAAEIRASANLAATKMSE

| SEQUENCES |
|---|
| CVLGQSKRVDFCKGYHLMSFPQSAPHGVVFLHVTYVPAQEKNFTTAPAICHDGKAHFPREGVFVSNGTHWFVTQRNFYEPQ<br>IITTDNTFVSGNCDVVIGIVNNTVYDPLQPELDSFKEELDKYFKNHTSPDVDLGDISGINASVVNIQKEIDRLNEVAKNLNESLIDL<br>QELGKYEQYIKWPWYIWLGFIAGLIAIVMVTIMLCCMTSCCSCLKGCCSCGSCCKFDEDDSEPVLKGVKLHYT |
| >MW306426.1 Severe acute respiratory syndrome coronavirus 2 isolate SARS-CoV-2/human/USA/CA-CZB-12872/2020, complete genome. [Severe acute respiratory syndrome coronavirus 2 (SARS-CoV-2)]. Californian B.1.429 lineage<br>SEQ ID NO: 26<br>ACTTTCGATCTCTTGTAGATCTGTTCTCTAAACGAACTTTAAAATCTGTGTGGCTGTCACTCGGCTGCATGCTTAGTGCACTC<br>ACGCAGTATAATTAATAACTAATTACTGTCGTTGACAGGACACGAGTAACTCGTCTATCTTCTGCAGGCTGCTTACGGTTTC<br>GTCCGTGTTGCAGCCGATCATCAGCACATCTAGGTTTTGTCCGGGTGTGACCGAAAGGTAAGATGGAGAGCCTTGTCCCT<br>GGTTTCAACGAGAAAACACACGTCCAACTCAGTTTGCCTGTTTTACAGGTTCGCGACGTGCTCGTACGTGGCTTTGGAGAC<br>TCCGTGGAGGAGGTCTTATCAGAGGCACGTCAACATCTTAAAGATGGCACTTGTGGCTTAGTAGAAGTTGAAAAAGGCGT<br>TTTGCCTCAACTTGAACAGCCCTATGTGTTCATCAAACGTTCGGATGCTCGAACTGCACCTCATGGTCATGTTATGGTTGAG<br>CTGGTAGCAGAACTCGAAGGCATTCAGTACGGTCGTAGTGGTGAGACACTTGGTGTCCTTGTCCCTCATGTGGGCGAAAT<br>ACCAGTGGCTTACCGCAAGGTTCTTCTTCGTAAGAACGGTAATAAAGGAGCTGGTGGCCATAGTTACGGCGCCGATCTAA<br>AGTCATTTGACTTAGGCGACGAGCTTGGCACTGATCCTTATGAAGATTTTCAAGAAAACTGGAACACTAAACATAGCAGTG<br>GTGTTACCCGTGAACTCATGCGTGAGCTTAACGGAGGGGCATACACTCGCTATGTCGATAACAACTTCTGTGGCCCTGATG<br>GCTACCCTCTTGAGTGCATTAAAGACCTTCTAGCACGTGCTGGTAAAGCTTCATGCACTTTGTCCGAACAACTGGACTTTAT<br>TGACACTAAGAGGGGTGTATACTGCTGCCGTGAACATGAGCATGAAATTGCTTGGTACACGGAACGTTCTGAAAAGAGCT<br>ATGAATTGCAGACACCTTTTGAAATTAAATTGGCAAAGAAATTTGACATCTTCAATGGGAATGTCCAAATTTTGTATTTCC<br>CTTAAATTCCATAATCAAGACTATTCAACCAAGGGTTGAAAAGAAAAAGCTTGATGGCTTTATGGGTAGAATTCGATCTGT<br>CTATCCAGTTGCGTCACCAAATGAATGCAACCAAATGTGCCTTTCAACTCTCATGAAGTGTGATCATTGTGGTGAAACTTCA<br>TGGCAGACGGGCGATTTTGTTAAAGCCACTTGCGAATTTTGTGGCACTGAGAATTTGACTAAAGAAGGTGCCACTACTTGT<br>GGTTACTTACCCCAAAATGCTGTTGTTAAAATTTATTGTCCAGCATGTCACAATTCAGAAGTAGGACCTGAGCATAGTCTTG<br>CCGAATACCATAATGAATCTGGCTTGAAAACCATTCTTCGTAAGGGTGGTCGCACTATTGCCTTTGGAGGCTGTGTGTTCTC<br>TTATGTTGGTTGCCATAACAAGTGTGCCTATTGGGTTCCACGTGCTAGCGCTAACATAGGTTGTAACCATACAGGTGTTGTT<br>GGAGAAGGTTCCGAAGGTCTTAATGACAACCTTCTTGAAATACTCCAAAAAGAGAAAGTCAACATCAATATTGTTGGTGAC<br>TTTAAACTTAATGAAGAGATCGCCATTATTTTGGCATCTTTTTCTGCTTCCACAAGTGCTTTTGTGGAAACTGTGAAAGGTTT<br>GGATTATAAAGCATTCAAACAAATTGTTGAATCCTGTGGTAATTTTAAAGTTACAAAAGGAAAAGCTAAAAAGGTGCCTG<br>GAATATTGGTGAACAGAAATCAATACTGAGTCCTCTTTATGCATTTGCATCAGAGGCTGCTCGTGTTGTACGATCAATTTTC<br>TCCCGCACTCTTGAAACTGCTCAAAATTCTGTGCGTGTTTTACAGAAGGCCGCTATAACAATACTAGATGGAATTTCACAGT<br>ATTCACTGAGACTCATTGATGCTATGATGTTCACATCTGATTTGGCTACTAACAATCTAGTTGTAATGGCCTACATTACAGG<br>TGGTGTTGTTCAGTTGACTTCGCAGTGGCTAACTAACATCTTTGGCACTGTTTATGAAAAACTCAAACCCGTCCTTGATTGG<br>CTTGAAGAGAAGTTTAAGGAAGGTGTAGAGTTTCTTAGAGACGGTTGGGAAATTGTTAAATTTATCTCAACCTGTGCTTGT<br>GAAATTGTCGGTGGACAAATTGTCACCTGTGCAAAGGAAATTAAGGAGAGTGTTCAGACATTCTTTAAGCTTGTAAATAAA<br>TTTTTGGCTTTGTGTGCTGACTCTATCATTATTGGTGGAGCTAAACTTAAAGCCTTGAATTTAGGTGAAACATTTGTTACGC<br>ACTCAAAGGGATTGTACAGAAAGTGTGTTAAATCCAGAGAAGAAACTGGCCTACTCATGCCTCTAAAAGCCCCAAAAGAA<br>ATTATCTTCTTAGAGGGAGAAACACTTCCCACAGAAGTGTTAACAGAGGAAGTTGTCTTGAAAACTGGTGATTTACAACCA<br>TTAGAACAACCTACTAGTGAAGCTGTTGAAGCTCCACTGGTTGGTACACCAGTTTGTATTAACGGGCTTATGTTGCTCGAA<br>ATCAAAGACACAGAAAAGTACTGTGCCCTTGCACCTAATATGATGGTAACAAACAATACCTTCACACTCAAAGGCGGTGCA<br>CCAACAAAGGTTACTTTTGGTGATGACACTGTGATAGAAGTGCAAGGTTACAAGAGTGTGAATATCACTTTTGAACTTGAT |

SEQUENCES

GAAAGGATTGATAAAGTACTTAATGAGAAGTGCTCTGCCTATACAGTTGAACTCGGTACAGAAGTAAATGAGTTCGCCTGT

GTTGTGGCAGATGCTGTCATAAAAACTTTGCAACCAGTATCTGAATTACTTACACCACTGGGCATTGATTTAGATGAGTGG

AGTATGGCTACATACTACTTATTTGATGAGTCTGGTGAGTTTAAATTGGCTTCACATATGTATTGTTCTTTTTACCCTCCAGA

TGAGGATGAAGAAGAAGGTGATTGTGAAGAAGAAGAGTTTGAGCCATCAACTCAATATGAGTATGGTACTGAAGATGAT

TACCAAGGTAAACCTTTGGAATTTGGTGCCACTTCTGCTGCTCTTCAACCTGAAGAAGAGCAAGAAGAAGATTGGTTAGAT

GATGATAGTCAACAAACTGTTGGTCAACAAGACGGCAGTGAGGACAATCAGACAACTACTATTCAAACAATTGTTGAGGT

TCAACCTCAATTAGAGATGAACTTACACCAGTTGTTCAGACTATTGAAGTGAATAGTTTTAGTGGTTATTTAAAACTTACT

GACAATGTATACATTAAAAATGCAGACATTGTGGAAGAAGCTAAAAAGGTAAAACCAACAGTGGTTGTTAATGCAGCCAA

TGTTTACCTTAAACATGGAGGAGGTGTTGCAGGAGCCTTAAATAAGGCTACTAACAATGCCATGCAAGTTGAATCTGATGA

TTACATAGCTACTAATGGACCACTTAAAGTGGGTGGTAGTTGTGTTTTAAGCGGACACAATCTTGCTAAACACTGTCTTCAT

GTTGTCGGCCCAAATGTTAACAAAGGTGAAGACATTCAACTTCTTAAGAGTGCTTATGAAAATTTTAATCAGCACGAAGTT

CTACTTGCACCATTATTATCAGCTGGTATTTTTGGTGCTGACCCTATACATTCTTTAAGAGTTTGTGTAGATACTGTTCGCAC

AAATGTCTACTTAGCTGTCTTTGATAAAAATCTCTATGACAAACTTGTTTCAAGCTTTTTGGAAATGAAGAGTGAAAAGCAA

GTTGAACAAAAGATCGCTGAGATTCCTAAAGAGGAAGTTAAGCCATTTATAACTGAAAGTAAACCTTCAGTTGAACAGAG

AAAACAAGATGATAAGAAAATCAAAGCTTGTGTTGAAGAAGTTACAACAACTCTGGAAGAAACTAAGTTCCTCACAGAAA

ACTTGTTACTTTATATTGACATTAATGGCAATCTTCATCCAGATTCTGCCACTCTTGTTAGTGACATTGACATCACTTTCTTAA

AGAAAGATGCTCCATATATAGTGGGTGATGTTGTTCAAGAGGGTGTTTTAACTGCTGTGGTTATACCTACTAAAAAGGCTG

GTGGCACTACTGAAATGCTAGCGAAAGCTTTGAGAAAAGTGCCAACAGACAATTATATAACCACTTACCCGGGTCAGGGT

TTAAATGGTTACACTGTAGAGGAGGCAAAGACAGTGCTTAAAAAGTGTAAAAGTGCCTTTTACATTCTACCATCTATTATCT

CTAATGAGAAGCAAGAAATTCTTGGAACTGTTTCTTGGAATTTGCGAGAAATGCTTGCACATGCAGAAGAAACACGCAAA

TTAATGCCTGTCTGTGTGGAAACTAAAGCCATAGTTTCAACTATACAGCGTAAATATAAGGGTATTAAAATACAAGAGGGT

GTGGTTGATTATGGTGCTAGATTTTACTTTTACACCAGTAAAACAACTGTAGCGTCACTTATCAACACACTTAACGATCTAA

ATGAAACTCTTGTTACAATGCCACTTGGCTATGTAACACATGGCTTAAATTTGGAAGAAGCTGCTCGGTATATGAGATCTCT

CAAAGTGCCAGCTACAGTTTCTGTTTCTTCACCTGATGCTGTTACAGCGTATAATGGTTATCTTACTTCTTCTTCTAAAACAC

CTGAAGAACATTTTATTGAAACCATCTCACTTGCTGGTTCCTATAAAGATTGGTCCTATTCTGGACAATCTACACAACTAGG

TATAGAATTTCTTAAGAGAGGTGATAAAAGTGTATATTACACTAGTAATCCTACCACATTCCACCTAGATGGTGAAGTTATC

ACCTTTGACAATCTTAAGACACTTCTTTCTTTGAGAGAAGTGAGGACTATTAAGGTGTTTACAACAGTAGACAACATTAACC

TCCACACGCAAGTTGTGGACATGTCAATGACATATGGACAACAGTTTGGTCCAACTTATTTGGATGGAGCTGATGTTACTA

AAATAAAACCTCATAATTCACATGAAGGTAAAACATTTTATGTTTTACCTAATGATGACACTCTACGTGTTGAGGCTTTTGA

GTACTACCACACAACTGATCCTAGTTTTCTGGGTAGGTACATGTCAGCATTAAATCACACTAAAAAGTGGAAATACCCACA

AGTTAATGGTTTAACTTCTATTAAATGGGCAGATAACAACTGTTATCTTGCCACTGCATTGTTAACACTCCAACAAATAGAG

TTGAAGTTTAATCCACCTGCTCTACAAGATGCTTATTACAGAGCAAGGGCTGGTGAAGCTGCTAACTTTTGTGCACTTATCT

TAGCCTACTGTAATAAGACAGTAGGTGAGTTAGGTGATGTTAGAGAAACAATGAGTTACTTGTTTCAACATGCCAATTTAG

ATTCTTGCAAAAGAGTCTTGAACGTGGTGTGTAAAACTTGTGGACAACAGCAGACAACCCTTAAGGGTGTAGAAGCTGTT

ATGTACATGGGCACACTTTCTTATGAACAATTTAAGAAAGGTGTTCAGATACCTTGTACGTGTGGTAAACAAGCTACAAAA

TATCTAGTACAACAGGAGTCACCTTTTGTTATGATGTCAGCACCACCTGCTCAGTATGAACTTAAGCATGGTACATTTACTT

GTGCTAGTGAGTACACTGGTAATTACCAGTGTGGTCACTATAAACATATAACTTCTAAAGAAACTTTGTATTGCATAGACG

GTGCTTTACTTACAAAGTCCTCAGAATACAAAGGTCCTATTACGGATGTTTTCTACAAAGAAAACAGTTACACAACAACCAT

| SEQUENCES |
|---|
| AAAACCAGTTACTTATAAATTGGATGGTGTTGTTTGTACAGAAATTGACCCTAAGTTGGACAATTATTATAAGAAAGACAA |
| TTCTTATTTCACAGAGCAACCAATTGATCTTGTACCAAACCAACCATATCCAAACGCAAGCTTCGATAATTTTAAGTTTGTA |
| TGTGATAATATCAAATTTGCTGATGATTTAAACCAGTTAACTGGTTATAAGAAACCTGCTTCAAGAGAGCTTAAAGTTACAT |
| TTTTCCCTGACTTAAATGGTGATGTGGTGGCTATTGATTATAAACACTACACACCCTCTTTTAAGAAAGGAGCTAAATTGTT |
| ACATAAACCTATTGTTTGGCATGTTAACAATGCAACTAATAAAGCCACGTATAAACCAAATACCTGGTGTATACGTTGTCTT |
| TGGAGCACAAAACCAGTTGAAACATCAAATTCGTTTGATGTACTGAAGTCAGAGGACGCGCAGGGAATGGATAATCTTGC |
| CTGCGAAGATCTAAAACCAGTCTCTGAAGAAGTAGTGGAAAATCCTACCATACAGAAAGACGTTCTTGAGTGTAATGTGA |
| AAACTACCGAAGTTGTAGGAGACATTATACTTAAACCAGCAAATAATAGTTTAAAAATTACAGAAGAGGTTGGCCACACA |
| GATCTAATGGCTGCTTATGTAGACAATTCTAGTCTTACTATTAAGAAACCTAATGAATTATCTAGAGTATTAGGTTTGAAAA |
| CCCTTGCTACTCATGGTTTAGCTGCTGTTAATAGTGTCCCTTGGGATACTATAGCTAATTATGCTAAGCCTTTTCTTAACAAA |
| GTTGTTAGTACAACTACTAACATAGTTACACGGTGTTTAAACCGTGTTTGTACTAATTATATGCCTTATTTCTTTACTTTATTG |
| CTACAATTGTGTACTTTTACTAGAAGTACAAATTCTAGAATTAAAGCATCTATGCCGACTACTATAGCAAAGAATACTGTTA |
| AGAGTGTCGGTAAATTTTGTCTAGAGGCTTCATTTAATTATTTGAAGTCACCTAATTTTTCTAAACTGATAAATATTATAATT |
| TGGTTTTTACTATTAAGTGTTTGCCTAGGTTCTTTAATCTACTCAACCGCTGCTTTAGGTGTTTTAATGTCTAATTTAGGCAT |
| GCCTTCTTACTGTACTGGTTACAGAGAAGGCTATTTGAACTCTACTAATGTCACTATTGCAACCTACTGTACTGGTTCTATAC |
| CTTGTAGTGTTTGTCTTAGTGGTTTAGATTCTTTAGACACCTATCCTTCTTTAGAAACTATACAAATTACCATTTCATCTTTTA |
| AATGGGATTTAACTGCTTTTGGCTTAGTTGCAGAGTGGTTTTTGGCATATATTCTTTTCACTAGGTTTTTCTATGTACTTGGA |
| TGGCTGCAATCATGCAATTGTTTTCAGCTATTTTGCAGTACATTTTATTAGTAATTCTTGGCTTATGTGGTTAATAATTAAT |
| CTTGTACAAATGGCCCCGATTTCAGCTATGGTTAGAATGTACATCTTCTTTGCATCATTTTATTATGTATGGAAAAGTTATGT |
| GCATGTTGTAGACGGTTGTAATTCATCAACTTGTATGATGTGTTACAAACGTAATAGAGCAACAAGAGTCGAATGTACAAC |
| TATTGTTAATGGTGTTAGAAGGTCCTTTTATGTCTATGCTAATGGAGGTAAAGGCTTTTGCAAACTACACAATTGGAATTGT |
| GTTAATTGTGATACATTCTGTGCTGGTAGTACATTTATTAGTGATGAAGTTGCGAGAGACTTGTCACTACAGTTTAAAAGAC |
| CAATAAATCCTACTGACCAGTCTTCTTACATCGTTGATAGTGTTACAGTGAAGAATGGTTCCATCCATCTTTACTTTGATAAA |
| GCTGGTCAAAAGACTTATGAAAGACATTCTCTCTCTCATTTTGTTAACTTAGACAACCTGAGAGCTAATAACACTAAAGGTT |
| CATTGCCTATTAATGTTATAGTTTTTGATGGTAAATCAAAATGTGAAGAATCATCTGCAAAATCAGCGTCTGTTTACTACAG |
| TCAGCTTATGTGTCAACCTATACTGTTACTAGATCAGGCATTAGTGTCTGATGTTGGTGATAGTGCGGAAGTTGCAGTTAA |
| AATGTTTGATGCTTACGTTAATACGTTTTCATCAACTTTTAACGTACCAATGGAAAAACTCAAAACACTAGTTGCAACTGCA |
| GAAGCTGAACTTGCAAAGAATGTGTCCTTAGACAATGTCTTATCTACTTTTATTTCAGCAGCTCGGCAAGGGTTTGTTGATT |
| CAGATGTAGAAACTAAAGATGTTGTTGAATGTCTTAAATTGTCACATCAATCTGACATAGAAGTTACTGGCGATAGTTGTA |
| ATAACTATATGCTCACCTATAACAAAGTTGAAAACATGACACCCCGTGACCTTGGTGCTTGTATTGACTGTAGTGCGCGTCA |
| TATTAATGCGCAGGTAGCAAAAAGTCACAACATTGCTTTGATATGGAACGTTAAAGATTTCATGTCATTGTCTGAACAACTA |
| CGAAAACAAATACGTAGTGCTGCTAAAAAGAATAACTTACCTTTTAAGTTGACATGTGCAACTACTAGACAAGTTGTTAAT |
| GTTGTAACAACAAAGATAGCACTTAAGGGTGGTAAAATTGTTAATAATTGGTTGAAGCAGTTAATTAAAGTTACACTTGTG |
| TTCCTTTTTGTTGCTGCTATTTTCTATTTAATAACACCTGTTCATGTCATGTCTAAACATACTGACTTTTCAAGTGAAATCATA |
| GGATACAAGGCTATTGATGGTGGTGTCACTCGTGACATAGCATCTACAGATACTTGTTTTGCTAACAAACATGCTGATTTTG |
| ACACATGGTTTAGCCAGCGTGGTGGTAGTTATACTAATGACAAAGCTTGCCCATTGATTGCTGCAGTCATAACAAGAGAAG |
| TGGGTTTTGTCGTGCCTGGTTTGCCTGGCACGATATTACGCACAACTAATGGTGACTTTTGCATTTCTTACCTAGAGTTTTT |
| AGTGCAGTTGGTAATATCTGTTACACACCATCAAAACTTATAGAGTACACTGACTTTGCAACATCAGCTTGTGTTTTGGCTG |
| CTGAATGTACAATTTTTAAAGATGCTTCTGGTAAGCCAGTACCATATTGTTATGATACCAATGTACTAGAAGGTTCTGTTGC |

| SEQUENCES |
|---|
| TTATGAAAGTTTACGCCCTGACACACGTTATGTGCTCATGGATGGCTCTATTATTCAATTTCCTAACACCTACCTTGAAGGTT |
| CTGTTAGAGTGGTAACAACTTTTGATTCTGAGTACTGTAGGCACGGCACTTGTGAAAGATCAGAAGCTGGTGTTTGTGTAT |
| CTACTAGTGGTAGATGGGTACTTAACAATGATTATTACAGATCTTTACCAGGAGTTTTCTGTGGTGTAGATGCTGTAAATTT |
| ACTTACTAATATGTTTACACCACTAATTCAACCTATTGGTGCTTTGGACATATCAGCATCTATAGTAGCTGGTGGTATTGTA |
| GCTATCGTAGTAACATGCCTTGCCTACTATTTTATGAGGTTTAGAAGAGCTTTTGGTGAATACAGTCATGTAGTTGCCTTTA |
| ATACTTTACTATTCCTTATGTCATTCACTGTACTCTGTTTAACACCAGTTTACTCATTCTTACCTGGTGTTTATTCTGTTATTTA |
| CTTGTACTTGACATTTTATCTTACTAATGATGTTTCTTTTTTAGCACATATTCAGTGGATGGTTATGTTCACACCTTTAGTACC |
| TTTCTGGATAACAATTGCTTATATCATTTGTATTTCCACAAAGCATTTCTATTGGTTCTTTAGTAATTACCTAAAGAGACGTG |
| TAGTCTTTAATGGTGTTTCCTTTAGTACTTTTGAAGAAGCTGCGCTGTGCACCTTTTTGTTAAATAAAGAAATGTATCTAAAG |
| TTGCGTAGTGATGTGCTATTACCTCTTACGCAATATAATAGATACTTAGCTCTTTATAATAAGTACAAGTATTTTAGTGGAG |
| CAATGGATACAACTAGCTACAGAGAAGCTGCTTGTTGTCATCTCGCAAAGGCTCTCAATGACTTCAGTAACTCAGGTTCTG |
| ATGTTCTTTACCAACCACCACAAACCTCTATCACCTCAGCTGTTTTGCAGAGTGGTTTTAGAAAAATGGCATTCCCATCTGGT |
| AAAGTTGAGGGTTGTATGGTACAAGTAACTTGTGGTACAACTACACTTAACGGTCTTTGGCTTGATGACGTAGTTTACTGT |
| CCAAGACATGTGATCTGCACCTCTGAAGACATGCTTAACCCTAATTATGAAGATTTACTCATTCGTAAGTCTAATCATAATTT |
| CTTGGTACAGGCTGGTAATGTTCAACTCAGGGTTATTGGACATTCTATGCAAATTGTGTACTTAAGCTTAAGGTTGATACA |
| GCCAATCCTAAGACACCTAAGTATAAGTTTGTTCGCATTCAACCAGGACAGACTTTTTCAGTGTTAGCTTGTTACAATGGTT |
| CACCATCTGGTGTTTACCAATGTGCTATGAGGCCCAATTTCACTATTAAGGGTTCATTCCTTAATGGTTCATGTGGTAGTGT |
| TGGTTTTAACATAGATTATGACTGTGTCTCTTTTTGTTACATGCACCATATGGAATTACCAACTGGAGTTCATGCTGGCACA |
| GACTTAGAAGGTAACTTTTATGGACCTTTTGTTGACAGGCAAACAGCACAAGCAGCTGGTACGGACACAACTATTACAGTT |
| AATGTTTTAGCTTGGTTGTACGCTGCTGTTATAAATGGAGACAGGTGGTTTCTCAATCGATTTACCACAACTCTTAATGACT |
| TTAACCTTGTGGCTATGAAGTACAATTATGAACCTCTAACACAAGACCATGTTGACATACTAGGACCTCTTTCTGCTCAAAC |
| TGGAATTGCCGTTTTAGATATGTGTGCTTCATTAAAAGAATTACTGCAAAATGGTATGAATGGACGTACCATATTGGGTAG |
| TGCTTTATTAGAAGATGAATTTACACCTTTTGATGTTGTTAGACAATGCTCAGGTGTTACTTTCCAAAGTGCAGTGAAAAGA |
| ACAATCAAGGGTACACACCACTGGTTGTTACTCACAATTTTGACTTCACTTTTAGTTTTAGTCCAGAGTACTCAATGGTCTTT |
| GTTCTTTTTTTGTATGAAAATGCCTTTTTACCTTTTGCTATGGGTATTATTGCTATGTCTGCTTTTGCAATGATGTTTGTCAA |
| ACATAAGCATGCATTTCTCTGTTTGTTTTTGTTACCTTCTCTTGCCACTGTAGCTTATTTTAATATGGTCTATATGCCTGCTAG |
| TTGGGTGATGCGTATTATGACATGGTTGGATATGGTTGATACTAGTTTGTCTGGTTTTAAGCTAAAAGACTGTGTTATGTAT |
| GCATCAGCTGTAGTGTTACTAATCCTTATGACAGCAAGAACTGTGTATGATGATGGTGCTAGGAGAGTGTGGACACTTATG |
| AATGTCTTGACACTCGTTTATAAAGTTTATTATGGTAATGCTTTAGATCAAGCCATTTCCATGTGGGCTCTTATAATCTCTGT |
| TACTTCTAACTACTCAGGTGTAGTTACAACTGTCATGTTTTTGGCCAGAGGTATTGTTTTTATGTGTGTTGAGTATTGCCCTA |
| TTTTCTTCATAACTGGTAATACACTTCAGTGTATAATGCTAGTTTATTGTTTCTTAGGCTATTTTTGTACTTGTTACTTTGGCC |
| TCTTTTGTTTACTCAACCGCTACTTTAGACTGACTCTTGGTGTTTATGATTACTTAGTTTCTACACAGGAGTTTAGATATATG |
| AATTCACAGGGACTACTCCCACCCAAGAATAGCATAGATGCCTTCAAACTCAACATTAAATTGTGGGTGTTGGTGGCAAA |
| CCTTGTATCAAAGTAGCCACTGTACAGTCTAAAATGTCAGATGTAAAGTGCACATCAGTAGTCTTACTCTCAGTTTTGCAAC |
| AACTCAGAGTAGAATCATCATCTAAATTGTGGGCTCAATGTGTCCAGTTACACAATGACATTCTCTTAGCTAAAGATACTAC |
| TGAAGCCTTTGAAAAAATGGTTTCACTACTTTCTGTTTTGCTTTCCATGCAGGGTGCTGTAGACATAAACAAGCTTTGTGAA |
| GAAATGCTGGACAACAGGGCAACCTTACAAGCTATAGCTTCAGAGTTTAGTTCCCTTCCATCATATGCAGCTTTTGCTACTG |
| CTCAAGAAGCTTATGAGCAGGCTGTTGCTAATGGTGATTCTGAAGTTGTTCTTAAAAAGTTGAAGAAGTCTTTGAATGTGG |

| SEQUENCES |
|---|
| CTAAATCTGAATTTGACCGTGATGCAGCCATGCAACGTAAGTTGGAAAAGATGGCTGATCAAGCTATGACCCAAATGTATA |
| AACAGGCTAGATCTGAGGACAAGAGGGCAAAAGTTACTAGTGCTATGCAGACAATGCTTTTCACTATGCTTAGAAAGTTG |
| GATAATGATGCACTCAACAACATTATCAACAATGCAAGAGATGGTTGTGTTCCCTTGAACATAATACCTCTTACAACAGCA |
| GCCAAACTAATGGTTGTCATACCAGACTATAACACATATAAAAATACGTGTGATGGTACAACATTTACTTATGCATCAGCAT |
| TGTGGGAAATCCAACAGGTTGTAGATGCAGATAGTAAAATTGTTCAACTTAGTGAAATTAGTATGGACAATTCACCTAATT |
| TAGCATGGCCTCTTATTGTAACAGCTTTAAGGGCCAATTCTGCTGTCAAATTACAGAATAATGAGCTTAGTCCTGTTGCACT |
| ACGACAGATGTCTTGTGCTGCCGGTACTACACAAACTGCTTGCACTGATGACAATGCGTTAGCTTACTACAACACAACAA |
| GGGAGGTAGGTTTGTACTTGCACTGTTATCCGATTTACAGGATTTGAAATGGGCTAGATTCCCTAAGAGTGATGGAACTG |
| GTACTGTCTATACAGAACTGGAACCACCTTGTAGGTTTGTTACAGACACACCTAAAGGTCCTAAAGTGAAGTATTTATACTT |
| TATTAAAGGATTAAACAACCTAAATAGAGGTATGGTACTTGGTAGTTTAGCTGCCACAGTACGTCTACAAGCTGGTAATGC |
| AACAGAAGTGCCTGCCAATTCAACTGTATTATCTTTCTGTGCTTTTGCTGTAGATGCTGCTAAAGCTTACAAAGATTATCTA |
| GCTAGTGGGGACAACCAATCACTAATTGTGTTAAGATGTTGTGTACACACTGGTACTGGTCAGGCAATAACAGTTACA |
| CCGGAAGCCAATATGGATCAAGAATCCTTTGGTGGTGCATCGTGTTGTCTGTACTGCCGTTGCCACATAGATCATCCAAAT |
| CCTAAAGGATTTTGTGACTTAAAAGGTAAGTATGTACAAATACCTACAACTTGTGCTAATGACCCTGTGGGTTTTACACTTA |
| AAAACACAGTCTGTACCGTCTGCGGTATGTGGAAAGGTTATGGCTGTAGTTGTGATCAACTCCGCGAACCCATGCTTCAGT |
| CAGCTGATGCACAATCGTTTTTAAACGGGTTTGCGGTGTAAGTGCAGCCCGTCTTACACCGTGCGGCACAGGCACTAGTAC |
| TGATGTCGTATACAGGGCTTTTGACATCTACAATGATAAAGTAGCTGGTTTTGCTAAATTCCTAAAAACTAATTGTTGTCGC |
| TTCCAAGAAAAGGACGAAGATGACAATTTAATTGATTCTTACTTTGTAGTTAAGAGACACACTTTCTCTAACTACCAACATG |
| AAGAAACAATTTATAATTTACTTAAGGATTGTCCAGCTGTTGCTAAACATGACTTCTTTAAGTTTAGAATAGACGGTGACAT |
| GGTACCACATATATCACGTCAACGTCTTACTAAATACACAATGGCAGACCTCGTCTATGCTTAAGGCATTTTGATGAAGGT |
| AATTGTGACACATTAAAAGAAATACTTGTCACATACAATTGTTGTGATGATGATTATTTCAATAAAAAGGACTGGTATGATT |
| TTGTAGAAAACCCAGATATATTACGCGTATACGCCAACTTAGGTGAACGTGTACGCCAAGCTTTGTTAAAAACAGTACAAT |
| TCTGTGATGCCATGCGAAATGCTGGTATTGTTGGTGTACTGACATTAGATAATCAAGATCTCAATGGTAACTGGTATGATTT |
| CGGTGATTTCATACAAACCACGCCAGGTAGTGGAGTTCCTGTTGTAGATTCTTATTATTCATTGTTAATGCCTATATTAACC |
| TTGACCAGGGCTTTAACTGCAGAGTCACATGTTGACACTGACTTAACAAAGCCTTACATTAAGTGGGATTTGTTAAAATAT |
| GACTTCACGGAAGAGAGGTTAAAACTCTTTGACCGTTATTTTAAATATTGGGATCAGACATACCACCCAAATTGTGTTAACT |
| GTTTGGATGACAGATGCATTCTGCATTGTGCAAACTTTAATGTTTTATTCTCTACAGTGTTCCCACTTACAAGTTTTGGACCA |
| CTAGTGAGAAAAATATTTGTTGATGGTGTTCCATTTGTAGTTTCAACTGGATACCACTTCAGAGAGCTAGGTGTTGTACATA |
| ATCAGGATGTAAACTTACATAGCTCTAGACTTAGTTTTAAGGAATTACTTGTGTATGCTGCTGACCCTGCTATGCACGCTGC |
| TTCTGGTAATCTATTACTAGATAAACGCACTACGTGCTTTTCAGTAGCTGCACTTACTAACAATGTTGCTTTTCAAACTGTCA |
| AACCCGGTAATTTTAACAAAGACTTCTATGACTTTGCTGTGTCTAAGGGTTTCTTTAAGGAAGGAAGTTCTGTTGAATTAAA |
| ACACTTCTTCTTTGCTCAGGATGGTAATGCTGCTATCAGCGATTATGACTACTATCGTTATAATCTACCAACAATGTGTGATA |
| TCAGACAACTACTATTTGTAGTTGAAGTTGTTGATAAGTACTTTGATTGTTACGATGGTGGCTGTATTAATGCTAACCAAGT |
| CATCGTCAACAACCTAGACAAATCAGCTGGTTTTCCATTTAATAAATGGGGTAAGGCTAGACTTTATTATGATTCAATGAGT |
| TATGAGGATCAAGATGCACTTTTCGCATATACAAAACGTAATGTCATCCCTACTATAACTCAAATGAATCTTAAGTATGCCA |
| TTAGTGCAAAGAATAGAGCTCGCACCGTAGCTGGTGTCTCTATCTGTAGTACTATGACCAATAGACAGTTTCATCAAAAAT |
| TATTGAAATCAATAGCCGCCACTAGAGGAGCTACTGTAGTAATTGGAACAAGCAAATTCTATGGTGGTTGGCACAACATGT |
| TAAAAACTGTTTATAGTGATGTAGAAAACCCTCACCTTATGGGTTGGGATTATCCTAAATGTGATAGAGCCATGCCTAACA |
| TGCTTAGAATTATGGCCTCACTTGTTCTTGCTCGCAAACATACAACGTGTTGTAGCTTGTCACACCGTTTCTATAGATTAGCT |

| SEQUENCES |
|---|
| AATGAGTGTGCTCAAGTATTGAGTGAAATGGTCATGTGTGGCGGTTCACTATATGTTAAACCAGGTGGAACCTCATCAGG |
| AGATGCCACAACTGCTTATGCTAATAGTGTTTTTAACATTTGTCAAGCTGTCACGGCCAATGTTAATGCACTTTTATCTACTG |
| ATGGTAACAAAATTGCCGATAAGTATGTCCGCAATTTACAACACAGACTTTATGAGTGTCTCTATAGAAATAGAGATGTTG |
| ACACAGACTTTGTGAATGAGTTTTACGCATATTTGCGTAAACATTTCTCAATGATGATACTCTCTGACGATGCTGTTGTGTG |
| TTTCAATAGCACTTATGCATCTCAAGGTCTAGTGGCTAGCATAAAGAACTTTAAGTCAGTTCTTTATTATCAAAACAATGTTT |
| TTATGTCTGAAGCAAAATGTTGGACTGAGACTGACCTTACTAAAGGACCTCATGAATTTTGCTCTCAACATACAATGCTAGT |
| TAAACAGGGTGATGATTATGTGTACCTTCCTTACCCAGATCCATCAAGAATCCTAGGGGCCGGCTGTTTTGTAGATGATAT |
| CGTAAAAACAGATGGTACACTTATGATTGAACGGTTCGTGTCTTTAGCTATAGATGCTTACCCACTTACTAAACATCCTAAT |
| CAGGAGTATGCTGATGTCTTTCATTTGTACTTACAATACATAAGAAAGCTACATGATGAGTTAACAGGACACATGTTAGAC |
| ATGTATTCTGTTATGCTTACTAATGATAACACTTCAAGGTATTGGGAACCTGAGTTTTATGAGGCTATGTACACACCGCATA |
| CAGTCTTACAGGCTGTTGGGGCTTGTGTTCTTTGCAATTCACAGACTTCATTAAGATGTGGTGCTTGCATACGTAGACCATT |
| CTTATGTTGTAAATGCTGTTACGACCATGTCATATCAACATCACATAAATTAGTCTTGTCTGTTAATCCGTATGTTTGCAATG |
| CTCCAGGTTGTGATGTCACAGATGTGACTCAACTTTACTTAGGAGGTATGAGCTATTATTGTAAATCACATAAACCACCCAT |
| TAGTTTTCCATTGTGTGCTAATGGACAAGTTTTTGGTTTATATAAAAATACATGTGTTGGTAGCGATAATGTTACTGACTTTA |
| ATGCAATTGCAACATGTGACTGGACAAATGCTGGTGATTACATTTTAGCTAACACCTGTACTGAAAGACTCAAGCTTTTTGC |
| AGCAGAAACGCTCAAAGCTACTGAGGAGACATTTAAACTGTCTTATGGTATTGCTACTGTACGTGAAGTGCTGTCTGACAG |
| AGAATTACATCTTTCATGGGAAGTTGGTAAACCTAGACCACCACTTAACCGAAATTATGTCTTTACTGGTTATCGTGTAACT |
| AAAAACAGTAAAGTACAAATAGGAGAGTACACCTTTGAAAAAGGTGACTATGGTGATGCTGTTGTTTACCGAGGTACAAC |
| AACTTACAAATTAAATGTTGGTGATTATTTTGTGCTGACATCACATACAGTAATGCCATTAAGTGCACCTACACTAGTGCCA |
| CAAGAGCACTATGTTAGAATTACTGGCTTATACCCAACACTCAATATCTCATATGAGTTTTCTAGCAATGTTGCAAATTATC |
| AAAAGGTTGGTATGCAAAAGTATTCTACACTCCAGGGACCACCTGGTACTGGTAAGAGTCATTTTGCTATTGGCCTAGCTC |
| TCTACTACCCTTCTGCTCGCATAGTGTATACAGCTTGCTCTCATGCCGCTGTTGATGCACTATGTGAGAAGGCATTAAAATA |
| TTTGCCTATAGATAAATGTAGTAGAATTATACCTGCACGTGCTCGTGTAGAGTGTTTTGATAAATTCAAAGTGAATTCAACA |
| TTAGAACAGTATGTCTTTTGTACTGTAAATGCATTGCCTGAGACGACAGCAGATATAGTTGTCTTTGATGAAATTTCAATGG |
| CCACAAATTATGATTTGAGTGTTGTCAATGCCAGATTACGTGCTAAGCACTATGTGTACATTGGCGACCCTGCTCAATTACC |
| TGCACCACGCACATTGCTAACTAAGGGCACACTAGAACCAGAATATTTCAATTCAGTGTGTAGACTTATGAAAACTATAGG |
| TCCAGACATGTTCCTCGGAACTTGTCGGCGTTGTCCTGCTGAAATTGTTGACACTGTGAGTGCTTTGGTTTATGATAATAAG |
| CTTAAAGCACATAAAGACAAATCAGCTCAATGCTTTAAAATGTTTTATAAGGGTGTTATCACGCATGATGTTTCATCTGCAA |
| TTAACAGGCCACAAATAGGCGTGGTAAGAGAATTCCTTACACGTAACCCTGCTTGGAGAAAAGCTGTCTTTATTTCACCTT |
| ATAATTCACAGAATGCTGTAGCCTCAAAGATTTTGGGACTACCAACTCAAACTGTTGATTCATCACAGGGCTCAGAATATG |
| ACTATGTCATATTCACTCAAACCACTGAAACAGCTCACTCTTGTAATGTAAACAGATTTAATGTTGCTATTACCAGAGCAAA |
| AGTAGGCATACTTTGCATAATGTCTGATAGAGACCTTTATGACAAGTTGCAATTTACAAGTCTTGAAATTCCACGTAGGAAT |
| GTGGCAACTTTACAAGCTGAAAATGTAACAGGACTCTTTAAAGATTGTAGTAAGGTAATCACTGGGTTACATCCTACACAG |
| GCACCTACACACCTCAGTGTTGACACTAAATTCAAAACTGAAGGTTTATGTGTTGACATACCTGGCATACCTAAGGACATG |
| ACCTATAGAAGACTCATCTCTATGATGGGTTTTAAAATGAATTATCAAGTTAATGGTTACCCTAACATGTTTATCACCCGCG |
| AAGAAGCTATAAGACATGTACGTGCATGGATTGGCTTCGATGTCGAGGGGTGTCATGCTACTAGAGAAGCTGTTGGTACC |
| AATTTACCTTTACAGCTAGGTTTTTCTACAGGTGTTAACCTAGTTGCTGTACCTACAGGTTATGTTGATACACCTAATAATAC |
| AGA11111CCAGAGTAGTGCTAAACCACCGCCTGGAGATCAATTAAACACCTCATACCACTATGTACAAAGGACTTCCT |

| SEQUENCES |
|---|
| TGGAATGTAGTGCGTATAAAGATTGTACAAATGTTAAGTGACACACTTAAAAATCTCTCTGACAGAGTCGTATTTGTCTTAT |
| GGGCACATGGCTTTGAGTTGACATCTATGAAGTATTTTGTGAAAATAGGACCTGAGCGCACCTGTTGTCTATGTGATAGAC |
| GTGCCACATGCTTTTCCACTGCTTCAGACACTTATGCCTGTTGGCATCATTCTATTGGATTTGATTACGTCTATAATCCGTTT |
| ATGATTGATGTTCAACAATGGGGTTTTACAGGTAACCTACAAAGCAACCATGATCTGTATTGTCAAGTCCATGGTAATGCA |
| CATGTAGCTAGTTGTGATGCAATCATGACTAGGTGTCTAGCTGTCCACGAGTGCTTTGTTAAGCGTGTTGACTGGACTATT |
| GAATATCCTATAATTGGTGATGAACTGAAGATTAATGCGGCTTGTAGAAAGGTTCAACACATGGTTGTTAAAGCTGCATTA |
| TTAGCAGACAAATTCCCAGTTCTTCACGACATTGGTAACCCTAAAGCTATTAAGTGTGTACCTCAAGCTGATGTAGAATGG |
| AAGTTCTATGATGCACAGCCTTGTAGTGACAAAGCTTATAAAATAGAAGAATTATTCTATTCTTATGCCACACATTCTGACA |
| AATTCACAGATGGTGTATGCCTATTTTGGAATTGCAATGTCGATAGATATCCTGCTAATTCCATTGTTTGTAGATTTGACACT |
| AGAGTGCTATCTAACCTTAACTTGCCTGGTTGTGATGGTGGCAGTTTGTATGTAAATAAACATGCATTCCACACACCAGCTT |
| TTGATAAAAGTGCTTTTGTTAATTTAAAACAATTACCATTTTTCTATTACTCTGACAGTCCATGTGAGTCTCATGGAAAACAA |
| GTAGTGTCAGATATAGATTATGTACCACTAAAGTCTGCTACGTGTATAACACGTTGCAATTTAGGTGGTGCTGTCTGTAGA |
| CATCATGCTAATGAGTACAGATTGTATCTCGATGCTTATAACATGATGATCTCAGCTGGCTTTAGCTTGTGGGTTTACAAAC |
| AATTTGATACTTATAACCTCTGGAACACTTTTACAAGACTTCAGAGTTTAGAAAATGTGGCTTTTAATGTTGTAAATAAGGG |
| ACACTTTGATGGACAACAGGGTGAAGTACCAGTTTCTATCATTAATAACACTGTTTACACAAAAGTTGATGGTGTTGATGT |
| AGAATTGTTTGAAAATAAAACAACATTACCTGTTAATGTAGCATTTGAGCTTTGGGCTAAGCGCAACATTAAACCAGTACC |
| AGAGGTGAAAATACTCAATAATTTGGGTGTGGACATTGCTGCTAATACTGTGATCTGGGACTACAAAGAGATGCTCCAG |
| CACATATATCTACTATTGGTGTTTGTTCTATGACTGACATAGCCAAGAAACCAACTGAAACGATTTGTGCACCACTCACTGT |
| CTTTTTTGATGGTAGAGTTGATGGTCAAGTAGACTTATTTAGAAATGCCCGTAATGGTGTTCTTATTACAGAAGGTAGTGTT |
| AAAGGTTTACAACCATCTGTAGGTCCCAAACAAGCTAGTCTTAATGGAGTCACATTAATTGGAGAAGCCGTAAAAACACAG |
| TTCAATTATTATAAGAAAGTTGATGGTGTTGTCCAACAATTACCTGAAACTTACTTTACTCAGAGTAGAAATTTACAAGAAT |
| TTAAACCCAGGAGTCAAATGGAAATTGATTTCTTAGAATTAGCTATGGATGAATTCATTGAACGGTATAAATTAGAAGGCT |
| ATGCCTTCGAACATATCGTTTATGGAGATTTTAGTCATAGTCAGTTAGGTGGTTTACATCTACTGATTGGACTAGCTAAACG |
| TTTTAAGGAATCACCTTTTGAATTAGAAGATTTTATTCCTATGGACAGTACAGTTAAAAACTATTTCATAACAGATGCGCAA |
| ACAGGTTCATCTAAGTGTGTGTGTTCTGTTATTGATTTATTACTTGATGATTTTGTTGAAATAATAAAATCCCAAGATTTATC |
| TGTAGTTTCTAAGGTTGTCAAAGTGACTATTGACTATACAGAAATTTCATTTATGCTTTGGTGTAAAGATGGCCATGTAGAA |
| ACATTTTACCCAAAATTACAATCTAGTCAAGCGTGGCAACCGGGTGTTGCTATGCCTAATCTTTACAAAATGCAAAGAATGC |
| TATTAGAAAAGTGTGACCTTCAAAATTATGGTGATAGTGCAACATTACCTAAAGGCATAATGATGAATGTCGCAAAATATA |
| CTCAACTGTGTCAATATTTAAACACATTAACATTAGCTGTACCCTATAATATGAGAGTTATACATTTTGGTGCTGGTTCTGAT |
| AAAGGAGTTGCACCAGGTACAGCTGTTTTAAGACAGTGGTTGCCTACGGGTACGCTGCTTGTCGATTCAGATCTTAATGAC |
| TTTGTCTCTGATGCAGATTCAACTTTGATTGGTGATTGTGCAACTGTACATACAGCTAATAAATGGGATCTCATTATTAGTG |
| ATATGTACGACCCTAAGACTAAAAATGTTACAAAAGAAAATGACTCTAAAGAGGGTTTTTTCACTTACATTTGTGGGTTTAT |
| ACAACAAAGCTAGCTCTTGGAGGTTCCGTGGCTATAAAGATAACAGAACATTCTTGGAATGCTGATCTTTATAAGCTCAT |
| GGGACACTTCGCATGGTGGACAGCCTTTGTTACTAATGTGAATGCGTCATCATCTGAAGCATTTTTAATTGGATGTAATTAT |
| CTGGCAAACCACGCGAACAAATAGATGGTTATGTCATGCATGCAAATTACATATTTTGGAGGAATACAAATCCAATTCAG |
| TTGTCTTCCTATTCTTTATTTGACATGAGTAAATTTCCCCTTAAATTAAGGGGTACTGCTGTTATGTCTTTAAAAGAAGGTCA |
| AATCAATGATATGATTTTATCTCTTCTTAGTAAAGGTAGACTTATAATTAGAGAAAACAACAGAGTTGTTATTTCTAGTGAT |
| GTTCTTGTTAACAACTAAACGAACAATGTTTGTTTTCTTGTTTTATTGCCACTAGTCTCTATTCAGTGTGTTAATCTTACAAC |
| CAGAACTCAATTACCCCCTGCATACACTAATTCTTTCACACGTGGTGTTTATTACCCTGACAAAGTTTTCAGATCCTCAGTTT |

```
TACATTCAACTCAGGACTTGTTCTTACCTTTCTTTTCCAATGTTACTTGGTTCCATGCTATACATGTCTCTGGGACCAATGGT

ACTAAGAGGTTTGATAACCCTGTCCTACCATTTAATGATGGTGTTTATTTTGCTTCCACTGAGAAGTCTAACATAATAAGAG

GCTGGATTTTTGGTACTACTTTAGATTCGAAGACCCAGTCCCTACTTATTGTTAATAACGCTACTAATGTTGTTATTAAAGTC

TGTGAATTTCAATTTTGTAATGATCCATTTTTGGGTGTTTATTACCACAAAAACAACAAAAGTTGTATGGAAAGTGAGTTCA

GAGTTTATTCTAGTGCGAATAATTGCACTTTTGAATATGTCTCTCAGCCTTTTCTTATGGACCTTGAAGGAAAACAGGGTAA

TTTCAAAAATCTTAGGGAATTTGTGTTTAAGAATATTGATGGTTATTTTAAAATATATTCTAAGCACACGCCTATTAATTTAG

TGCGTGATCTCCCTCAGGGTTTTTCGGCTTTAGAACCATTGGTAGATTTGCCAATAGGTATTAACATCACTAGGTTTCAAAC

TTTACTTGCTTTACATAGAAGTTATTTGACTCCTGGTGATTCTTCTTCAGGTTGGACAGCTGGTGCTGCAGCTTATTATGTGG

GTTATCTTCAACCTAGGACTTTTCTATTAAAATATAATGAAAATGGAACCATTACAGATGCTGTAGACTGTGCACTTGACCC

TCTCTCAGAAACAAAGTGTACGTTGAAATCCTTCACTGTAGAAAAAGGAATCTATCAAACTTCTAACTTTAGAGTCCAACCA

ACAGAATCTATTGTTAGATTTCCTAATATTACAAACTTGTGCCCTTTTGGTGAAGTTTTTAACGCCACCAGATTTGCATCTGT

TTATGCTTGGAACAGGAAGAGAATCAGCAACTGTGTTGCTGATTATTCTGTCCTATATAATTCCGCATCATTTTCCACTTTTA

AGTGTTATGGAGTGTCTCCTACTAAATTAAATGATCTCTGCTTTACTAATGTCTATGCAGATTCATTTGTAATTAGAGGTGAT

GAAGTCAGACAAATCGCTCCAGGGCAAACTGGAAAGATTGCTGATTATAATTATAAATTACCAGATGATTTTACAGGCTGC

GTTATAGCTTGGAATTCTAACAATCTTGATTCTAAGGTTGGTGGTAATTATAATTACCGGTATAGATTGTTTAGGAAGTCTA

ATCTCAAACCTTTTGAGAGAGATATTTCAACTGAAATCTATCAGGCCGGTAGCACACCTTGTAATGGTGTTGAAGGTTTTAA

TTGTTACTTTCCTTTACAATCATATGGTTTCCAACCCACTAATGGTGTTGGTTACCAACCATACAGAGTAGTAGTACTTTCTT

TTGAACTTCTACATGCACCAGCAACTGTTTGTGGACCTAAAAAGTCTACTAATTTGGTTAAAAACAAATGTGTCAATTTCAA

CTTCAATGGTTTAACAGGCACAGGTGTTCTTACTGAGTCAACAAAAAGTTTCTGCCTTTCCAACAATTTGGCAGAGACATT

GCTGACACTACTGATGCTGTCCGTGATCCACAGACACTTGAGATTCTTGACATTACACCATGTTCTTTTGGTGGTGTCAGTG

TTATAACACCAGGAACAAATACTTCTAACCAGGTTGCTGTTCTTTATCAGGGTGTTAACTGCACAGAAGTCCCTGTTGCTAT

TCATGCAGATCAACTTACTCCTACTTGGCGTGTTTATTCTACAGGTTCTAATGTTTTTCAAACACGTGCAGGCTGTTTAATAG

GGGCTGAACATGTCAACAACTCATATGAGTGTGACATACCCATTGGTGCAGGTATATGCGCTAGTTATCAGACTCAGACTA

ATTCTCCTCGGCGGGCACGTAGTGTAGCTAGTCAATCCATCATTGCCTACACTATGTCACTTGGTGCAGAAAATTCAGTTGC

TTACTCTAATAACTCTATTGCCATACCCACAAATTTTACTATTAGTGTTACCACAGAAATTCTACCAGTGTCTATGACCAAGA

CATCAGTAGATTGTACAATGTACATTTGTGGTGATTCAACTGAATGCAGCAATCTTTTGTTGCAATATGGCAGTTTTTGTAC

ACAATTAAACCGTGCTTTAACTGGAATAGCTGTTGAACAAGACAAAAACACCCAAGAAGTTTTTGCACAAGTCAAACAAAT

TTACAAAACACCACCAATTAAAGATTTTGGTGGTTTTAATTTTTCACAAATATTACCAGATCCATCAAAACCAAGCAAGAGG

TCATTTATTGAAGATCTACTTTTCAACAAAGTGACACTTGCAGATGCTGGCTTCATCAAACAATATGGTGATTGCCTTGGTG

ATATTGCTGCTAGAGACCTCATTTGTGCACAAAAGTTTAACGGCCTTACTGTTTTGCCACCTTTGCTCACAGATGAAATGAT

TGCTCAATACACTTCTGCACTGTTAGCGGGTACAATCACTTCTGGTTGGACCTTTGGTGCAGGTGCTGCATTACAAATACCA

TTTGCTATGCAAATGGCTTATAGGTTTAATGGTATTGGAGTTACACAGAATGTTCTCTATGAGAACCAAAAATTGATTGCCA

ACCAATTTAATAGCGCTATTGGCAAAATTCAAGACTCACTTTCTTCCACAGCAAGTGCACTTGGAAAACTTCAAGATGTGGT

CAACCAAAATGCACAAGCTTTAAACACGCTTGTTAAACAACTTAGCTCCAATTTTGGTGCAATTTCAAGTGTTTTAAATGAT

ATCCTTTCACGTCTTGACAAAGTTGAGGCTGAAGTGCAAATTGATAGGTTGATCACAGGCAGACTTCAAAGTTTGCAGACA

TATGTGACTCAACAATTAATTAGAGCTGCAGAAATCAGAGCTTCTGCTAATCTTGCTGCTACTAAAATGTCAGAGTGTGTAC

TTGGACAATCAAAAAGAGTTGATTTTTGTGGAAAGGGCTATCATCTTATGTCCTTCCCTCAGTCAGCACCTCATGGTGTAGT

CTTCTTGCATGTGACTTATGTCCCTGCACAAGAAAAGAACTTCACAACTGCTCCTGCCATTTGTCATGATGGAAAAGCACAC
```

| SEQUENCES |
|---|
| TTTCCTCGTGAAGGTGTCTTTGTTTCAAATGGCACACACTGGTTTGTAACACAAAGGAATTTTTATGAACCACAAATCATTA |
| CTACAGACAACACATTTGTGTCTGGTAACTGTGATGTTGTAATAGGAATTGTCAACAACACAGTTTATGATCCTTTGCAACC |
| TGAATTAGACTCATTCAAGGAGGAGTTAGATAAATATTTTAAGAATCATACATCACCAGATGTTGATTTAGGTGACATCTCT |
| GGCATTAATGCTTCAGTTGTAAACATTCAAAAAGAAATTGACCGCCTCAATGAGGTTGCCAAGAATTTAAATGAATCTCTC |
| ATCGATCTCCAAGAACTTGGAAAGTATGAGCAGTATATAAAATGGCCATGGTACATTTGGCTAGGTTTTATAGCTGGCTTG |
| ATTGCCATAGTAATGGTGACAATTATGCTTTGCTGTATGACCAGTTGCTGTAGTTGTCTCAAGGGCTGTTGTTCTTGTGGAT |
| CCTGCTGCAAATTTGATGAAGACGACTCTGAGCCAGTGCTCAAAGGAGTCAAATTACATTACACATAAACGAACTTATGGA |
| TTTGTTTATGAGAATCTTCACAATTGGAACTGTAACTTTGAAGCAAGGTGAAATCAAGGATGCTACTCCTTCAGATTTTGTT |
| CGCGCTACTGCAACGATACCGATACAAGCCTCACTCCCTTTCGGATGGCTTATTGTTGGCGTTGCACTTCTTGCTGTTTTTCA |
| TAGCGCTTCCAAAATCATAACCCTCAAAAAGAGATGGCAACTAGCACTCTCCAAGGGTGTTCACTTTGTTTGCAACTTGCTG |
| TTGTTGTTTGTAACAGTTTACTCACACCTTTTGCTCGTTGCTGTTGGCCTTGAAGCCCCTTTTCTCTATCTTTATGCTTTAGTC |
| TACTTCTTGCAGAGTATAAACTTTGTAAGAATAATAATGAGGCTTTGGCTTTGCTGGAAATGCCGTTCCAAAAACCCATTAC |
| TTTATGATGCCAACTATTTTCTTTGCTGGCATACTAATTGTTACGACTATTGTATACCTTACAATAGTGTAACTTCTTCAATTG |
| TCATTACTTCAGGTGATGGCACAACAAGTCCTATTTCTGAACATGACTACCAGATTGGTGGTTATACTGAAAAATGGGAAT |
| CTGGAGTAAAAGACTGTGTTGTATTACACAGTTACTTCACTTCAGACTATTACCAGCTGTACTCAACTCAATTGAGTACAGA |
| CACTGGTGTTGAACATGTTACCTTCTTCATCTACAATAAAATTGTTGATGAGCCTGAAGAACATGTCCAAATTCACACAATC |
| GACGGTTCATCCGGAGTTGTTAATCCAGTAATGGAACCAATTTATGATGAACCGACGACGACTACTAGCGTGCCTTTGTAA |
| GCACAAGCTGATGAGTACGAACTTATGTACTCATTCGTTTCGGAAGAGACAGGTACGTTAATAGTTAATAGCGTACTTCTT |
| TTTCTTGCTTTCGTGGTATTCTTGCTAGTTACACTAGCCATCCTTACTGCGCTTCGATTGTGTGCGTACTGCTGCAATATTGTT |
| AACGTGAGTCTTGTAAAACCTTCTTTTTACGTTTACTCTCGTGTTAAAAATCTGAATTCTTCTAGAGTTCCTGATCTTCTGGTC |
| TAAACGAACTAAATATTATATTAGTTTTTCTGTTTGGAACTTTAATTTTAGCCATGGCAGATTCCAACGGTACTATTACCGTT |
| GAAGAGCTTAAAAAGCTCCTTGAACAATGGAACCTAGTAATAGGTTTCCTATTCCTTACATGGATTTGTCTTCTACAATTTG |
| CCTATGCCAACAGGAATAGGTTTTTGTATATAATTAAGTTAATTTTTCTCTGGCTGTTATGGCCAGTAACTTTAGCTTGTTTT |
| GTGCTTGCTGCTGTTTACAGAATAAATTGGATCACCGGTGGAATTGCTATCGCAATGGCTTGTCTTGTAGGCTTGATGTGG |
| CTCAGCTACTTCATTGCTTCTTTCAGACTGTTTGCGCGTACGCGTTCCATGTGGTCATTCAATCCAGAAACTAACATTCTTCT |
| CAACGTGCCACTCCATGGCACTATTCTGACCAGACCGCTTCTAGAAAGTGAACTCGTAATCGGAGCTGTGATCCTTCGTGG |
| ACATCTTCGTATTGCTGGACACCATCTAGGACGCTGTGACATCAAGGACCTGCCTAAAGAAATCACTGTTGCTACATCACG |
| AACGCTTTCTTATTACAAATTGGGAGCTTCGCAGCGTGTAGCAGGTGACTCAGGTTTTGCTGCATACAGTCGCTACAGGAT |
| TGGCAACTATAAATTAAACACAGACCATTCCAGTAGCAGTGACAATATTGCTTTGCTTGTACAGTAAGTGACAACAGATGT |
| TTCATCTCGTTGACTTTCAGGTTACTATAGCAGAGATATTACTAATTATTATGAGGACTTTTAAAGTTTCCATTTGGAATCTT |
| GATTACATCATAAACCTCATAATTAAAAATTTATCTAAGTCACTAACTGAGAATAAATATTCTCAATTAGATGAAGAGCAAC |
| CAATGGAGATTGATTAAACGAACATGAAAATTATTCTTTTCTTGGCACTGATAACACTCGCTACTTGTGAGCTTTATCACTA |
| CCAAGAGTGTGTTAGAGGTACAACAGTACTTTTAAAAGAACCTTGCTCTTCTGGAACATACGAGGGCAATTCACCATTTCA |
| TCCTCTAGCTGATAACAAATTTGCACTGACTTGCTTTAGCACTCAATTTGCTTTTGCTTGTCCTGACGGCGTAAAACACGTCT |
| ATCAGTTACGTGCCAGATCAGTTTCACCTAAACTGTTCATCAGACAAGAGGAAGTTCAAGAACTTTACTCTCCAATTTTTCTT |
| ATTGTTGCGGCAATAGTGTTTATAACACTTTGCTTCACACTCAAAAGAAAGACAGAATGATTGAACTTTCATTAATTGACTT |
| CTATTTGTGCTTTTTAGCCTTTCTGCTATTCCTTGTTTTAATTATGCTTATTATCTTTTGGTTCTCACTTGAACTGCAAGATCAT |
| AATGAAACTTGTCACGCCTAAACTAACATGAAATTTCTTGTTTTCTTAGGAATCATCACAACTGTAGCTGCATTTCACCAAG |
| AATGTAGTTTACAGTCATGTACTCAACATCAACCATATGTAGTTGATGACCCGTGTCCTATTCACTTCTATTCTAAATGGTAT |

-continued

SEQUENCES

ATTAGAGTAGGAGCTAGAAAATCAGCACCTTTAATTGAATTGTGCGTGGATGAGGCTGGTTCTAAATCACCCATTCAGTAC

ATCGATATCGGTAATTATACAGTTTCCTGTTTACCTTTTACAATTAATTGCCAGGAACCTAAATTGGGTAGTCTTGTAGTGC

GTTGTTCGTTCTATGAAGACTTTTTAGAGTATCATGACGTTCGTGTTGTTTTAGATTTCATCTAAACGAACAAACTATAATGT

CTGATAATGGACCCCAAAATCAGCGAAATGCACCCCGCATTACGTTTGGTGGACCCTCAGATTCAACTGGCAGTAACCAGA

ATGGAGAACGCAGTGGGGCGCGATCAAAACAACGTCGGCCCCAAGGTTTACCCAATAATACTGCGTCTTGGTTCACCGCT

CTCACTCAACATGGCAAGGAAGACCTTAAATTCCCTCGAGGACAAGGCGTTCCAATTAACACCAATAGCAGTCCAGATGAC

CAAATTGGCTACTACCGAAGAGCTACCAGACGAATTCGTGGTGGTGACGGTAAAATGAAAGATCTCAGTCCAAGATGGT

ATTTCTACTACCTAGGAACTGGGCCAGAAGCTGGACTTCCCTATGGTGCTAACAAAGACGGCATCATATGGGTTGCAACTG

AGGGAGCCTTGAATACACCAAAAGATCACATTGGCACCCGCAATCCTGCTAACAATGCTGCAATCGTGCTACAACTTCCTC

AAGGAACAACATTGCCAAAAGGCTTCTACGCAGAAGGGAGCAGAGGCGGCAGTCAAGCCTCTTCTCGTTCCTCATCACGT

AGTCGCAACAGTTCAAGAAATTCAACTCCAGGCAGCAGTAGGGGAATTTCTCCTGCTAGAATGGCTGGCAATGGCGGTGA

TGCTGCTCTTGCTTTGCTGCTGCTTGACAGATTGAACCAGCTTGAGAGCAAAATGTCTGGTAAAGGCCAACAACAACAAGG

CCAAACTGTCACTAAGAAATCTGCTGCTGAGGCTTCTAAGAAGCCTCGGCAAAAACGTACTGCCACTAAAGCATACAATGT

AACACAAGCTTTCGGCAGACGTGGTCCAGAACAAACCCAAGGAAATTTTGGGGACCAGGAACTAATCAGACAAGGAACT

GATTACAAACATTGGCCGCAAATTGCACAATTTGCCCCCAGCGCTTCAGCGTTCTTCGGAATGTCGCGCATTGGCATGGAA

GTCACACCTTCGGGAACGTGGTTGACCTACACAGGTGCCATCAAATTGGATGACAAAGATCCAAATTTCAAAGATCAAGTC

ATTTTGCTGAATAAGCATATTGACGCATACAAAACATTTCCACCAACAGAGCCTAAAAAGGACAAAAAGAAGAAGGCTGA

TGAAACTCAAGCCTTACCGCAGAGACAGAAGAAACAGCAAACTGTGACTCTTCTTCCTGCTGCAGATTTGGATGATTTCTC

CAAACAATTGCAACAATCCATGAGCAGTGCTGACTCAACTCAGGCCTAAACTCATGCAGACCACACAAGGCAGATGGGCT

ATATAAACGTTTTCGCTTTTCCGTTTACGATATATAGTCTACTCTTGTGCAGAATGAATTCTCGTAACTACATAGCACAAGTA

GATGTAGTTAACTTTAATCTCACATAGCAATCTTTAATCAGTGTGTAACATTAGGGAGGACTTGAAAGAGCCACCACATTTT

CACCGAGGCCACGCGGAGTACGATCGAGTGTACAGTGAACAATGCTAGGGAGAGCTGCCTATATGGAAGAGCCCTAATG

TGTAAAATTAATTTTAGTAGTGCTATCCCCATGTGATTTTAATAGC

>QPJ72086.1. S-protein surface glycoprotein

SEQ ID NO: 27

MFVFLVLLPLVSIQCVNLTTRTQLPPAYTNSFTRGVYYPDKVFRSSVLHSTQDLFLPFFSNVTWFHAIHVSGTNGTKRFDNPVLPF

NDGVYFASTEKSNIIRGWIFGTTLDSKTQSLLIVNNATNVVIKVCEFQFCNDPFLGVYYHKNNKSCMESEFRVYSSANNCTFEYVS

QPFLMDLEGKQGNFKNLREFVFKNIDGYFKIYSKHTPINLVRDLPQGFSALEPLVDLPIGINITRFQTLLALHRSYLTPGDSSSGWT

AGAAAYYVGYLQPRTFLLKYNENGTITDAVDCALDPLSETKCTLKSFTVEKGIYQTSNFRVQPTESIVRFPNITNLCPFGEVFNATR

FASVYAWNRKRISNCVADYSVLYNSASFSTFKCYGVSPTKLNDLCFTNVYADSFVIRGDEVRQIAPGQTGKIADYNYKLPDDFTG

CVIAWNSNNLDSKVGGNYNYRYRLFRKSNLKPFERDISTEIYQAGSTPCNGVEGFNCYFPLQSYGFQPTNGVGYQPYRVVVLSF

ELLHAPATVCGPKKSTNLVKNKCVNFNFNGLTGTGVLTESNKKFLPFQQFGRDIADTTDAVRDPQTLEILDITPCSFGGVSVITPG

TNTSNQVAVLYQGVNCTEVPVAIHADQLTPTWRVYSTGSNVFQTRAGCLIGAEHVNNSYECDIPIGAGICASYQTQTNSPRRAR

SVASQSIIAYTMSLGAENSVAYSNNSIAIPTNFTISVTTEILPVSMTKTSVDCTMYICGDSTECSNLLLQYGSFCTQLNRALTGIAVE

QDKNTQEVFAQVKQIYKTPPIKDFGGFNFSQILPDPSKPSKRSFIEDLLFNKVTLADAGFIKQYGDCLGDIAARDLICAQKFNGLTV

LPPLLTDEMIAQYTSALLAGTITSGWTFGAGAALQIPFAMQMAYRFNGIGVTQNVLYENQKLIANQFNSAIGKIQDSLSSTASAL

GKLQDVVNQNAQALNTLVKQLSSNFGAISSVLNDILSRLDKVEAEVQIDRLITGRLQSLQTYVTQQLIRAAEIRASANLAATKMSE

CVLGQSKRVDFCGKGYHLMSFPQSAPHGVVFLHVTYVPAQEKNFTTAPAICHDGKAHFPREGVFVSNGTHWFVTQRNFYEPQ

IITTDNTFVSGNCDVVIGIVNNTVYDPLQPELDSFKEELDKYFKNHTSPDVDLGDISGINASVVNIQKEIDRLNEVAKNLNESLIDL

| SEQUENCES | |
|---|---|
| QELGKYEQYIKWPWYIWLGFIAGLIAIVMVTIMLCCMTSCCSCLKGCCSCGSCCKFDEDDSEPVLKGVKLHYT | |
| >nucleocapsid phosphoprotein [Severe acute respiratory syndrome coronavirus 2] (Accession No: QIA98561) | SEQ ID NO: 28 |
| MSDNGPQNQRNAPRITFGGPSDSTGSNQNGERSGARSKQRRPQGLPNNTASWFTALTQHGKEDLKFPRGQGVPINTNSSP DDQIGYYRRATRRIRGGDGKMKDLSPRWYFYYLGTGPEAGLPYGANKDGIIWVATEGALNTPKDHIGTRNPANNAAIVLQLP QGTTLPKGFYAEGSRGGSQASSRSSSRSRNSSRNSTPGSSRGTSPARMAGNGGDAALALLLLDRLNQLESKMSGKGQQQQG QTVTKKSAAEASKKPRQKRTATKAYNVTQAFGRRGPEQTQGNFGDQELIRQGTDYKHWPQIAQFAPSASAFFGMSRIGMEV TPSGTWLTYTGAIKLDDKDPNFKDQVILLNKHIDAYKTFPPTEPKKDKKKKADETQALPQRQKKQQTVTLLPAADLDDFSKQLQ QSMSSADSTQA | |
| >membrane glycoprotein [Severe acute respiratory syndrome coronavirus 2] (Accession No: QIA98557) | SEQ ID NO: 29 |
| MADSNGTITVEELKKLLEQWNLVIGFLFLTWICLLQFAYANRNRFLYIIKLIFLWLLWPVTLACFVLAAVYRINWITGGIAIAMACL VGLMWLSYFIASFRLFARTRSMWSFNPETNILLNVPLHGTILTRPLLESELVIGAVILRGHLRIAGHHLGRCDIKDLPKEITVATSRT LSYYKLGASQRVAGDSGFAAYSRYRIGNYKLNTDHSSSSDNIALLVQ | |
| >TLR9 agonist oligo | SEQ ID NO: 30 |
| AACGTTCGAG | |
| >modified oligo with 2'-deoxy-7-deazaguanosine | SEQ ID NO: 31 |
| TCG$_1$AACG$_1$TTCG$_1$<br>wherein G$_1$ is 2'-deoxy-7-deazaguanosine | |
| >modified oligo with 2'-deoxy-7-deazaguanosine and glycerol | SEQ ID NO: 32 |
| TCG$_1$AACG$_1$TTCG$_1$XG$_1$CTTG$_1$CAAG$_1$CT<br>wherein G$_1$ is 2'-deoxy-7-deazaguanosine and X is glycerol | |

SEQUENCE LISTING (32 sequences)

SEQ ID NO: 1 - DNA, 29903 bp, Unknown
  SARS-CoV-2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 2 - protein, 7096 aa, Unknown [sequence omitted]

SEQ ID NO: 3 - protein, 1273 aa, Unknown
  SARS-CoV-2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 4 - DNA, 22 bp, Artificial Sequence
  Synthetic
tgactgtgaacgttcgagatga

SEQ ID NO: 5 - protein, 11 aa, Artificial Sequence
  Synthetic
KLKLLLLLKLK

SEQ ID NO: 6 - DNA, 26 bp, Artificial Sequence
  Synthetic
  misc_feature (1)..(26): n=deoxyinosine
ncncncncncncncncncncncncnc

SEQ ID NO: 7 - DNA, 20 bp, Artificial Sequence
  Synthetic
tccatgacgttcctgacgtt

SEQ ID NO: 8 - DNA, 24 bp, Artificial Sequence
  Synthetic
tcgtcgttttgtcgttttgtcgtt

SEQ ID NO: 9 - DNA, 29867 bp, Unknown
  SARS-CoV-2
  misc_feature (11083)..(11083): n is a, c, g, or t
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgctaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttntatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacgtttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaat

SEQ ID NO: 10 - protein, 7062 aa, Unknown
  SARS-CoV-2
  misc_feature (3606)..(3606): Xaa can be any naturally occurring amino acid
MESLVPGFNEKTHVQLSLPVLQVRDVLVRGFGDSVEEVLSEARQHLKDGTCGLVEVEKGVLPQLEQPYVFIKRSDARTAPHGHVMVELVAELEGIQYGRSGETLGVLVPHVGEIPVAYRKVLLRKNGNKGAGGHSYGADLKSFDLGDELGTDPYEDFQENWNTKHSSGVTRELMRELNGGAYTRYVDNNFCGPDGYPLECIKDLLARAGKASCTLSEQLDFIDTKRGVYCCREHEHEIAWYTERSEKSYELQTPFEIKLAKKFDTFNGECPNFVFPLNSIIKTIQPRVEKKKLDGFMGRIRSVYPVASPNECNQMCLSTLMKCDHCGETSWQTGDFVKATCEFCGTENLTKEGATTCGYLPQNAVVKIYCPACHNSEVGPEHSLAEYHNESGLKTILRKGGRTIAFGGCVFSYVGCHNKCAYWVPRASANIGCNHTGVVGEGSEGLNDNLLEILQKEKVNINIVGDFKLNEEIAIILASFSASTSAFVETVKGLDYKAFKQIVESCGNFKVTKGKAKKGAWNIGEQKSILSPLYAFASEAARVVRSIFSRTLETAQNSVRVLQKAAITILDGISQYSLRLIDAMMFTSDLATNNLVVMAYITGGVVQLTSQWLTNIFGTVYEKLKPVLDWLEEKFKEGVEFLRDGWEIVKFISTCACEIVGGQIVTCAKEIKESVQTFFKLVNKFLALCADSIIIGGAKLKALNLGETFVTHSKGLYRKCVKSREETGLLMPLKAPKEIIFLEGETLPTEVLTEEVVLKTGDLQPLEQPTSEAVEAPLVGTPVCINGLMLLEIKDTEKYCALAPNMMVTNNTFTLKGGAPTKVTFGDDTVIEVQGYKSVNITFELDERIDKVLNEKCSAYTVELGTEVNEFACVVADAVIKTLQPVSELLTPLGIDLDEWSMATYYLFDESGEFKLASHMYCSFYPPDEDEEEGDCEEEEFEPSTQYEYGTEDDYQGKPLEFGATSAALQPEEEQEEDWLDDDSQQTVGQQDGSEDNQTTTIQTIVEVQPQLEMELTPVVQTIEVNSFSGYLKLTDNVYIKNADIVEEAKKVKPTVVVNAANVYLKHGGGVAGALNKATNNAMQVESDDYIATNGPLKVGGSCVLSGHNLAKHCLHVVGPNVNKGEDIQLLKSAYENFNQHEVLLAPLLSAGIFGADPIHSLRVCVDTVRTNVYLAVFDKNLYDKLVSSFLEMKSEKQVEQKIAEIPKEEVKPFITESKPSVEQRKQDDKKIKACVEEVTTTLEETKFLTENLLLYIDINGNLHPDSATLVSDIDITFLKKDAPYIVGDVVQEGVLTAVVIPTKKAGGTTEMLAKALRKVPTDNYITTYPGQGLNGYTVEEAKTVLKKCKSAFYILPSIISNEKQEILGTVSWNLREMLAHAEETRKLMPVCVETKAIVSTIQRKYKGIKIQEGVVDYGARFYFYTSKTTVASLINTLNDLNETLVTMPLGYVTHGLNLEEAARYMRSLKVPATVSVSSPDAVTAYNGYLTSSSKTPEEHFIETISLAGSYKDWSYSGQSTQLGIEFLKRGDKSVYYTSNPTTFHLDGEVITFDNLKTLLSLREVRTIKVFTTVDNINLHTQVVDMSMTYGQQFGPTYLDGADVTKIKPHNSHEGKTFYVLPNDDTLRVEAFEYYHTTDPSFLGRYMSALNHTKKWKYPQVNGLTSIKWADNNCYLATALLTLQQIELKFNPPALQDAYYRARAGEAANFCALILAYCNKTVGELGDVRETMSYLFQHANLDSCKRVLNVVCKTCGQQQTTLKGVEAVMYMGTLSYEQFKKGVQIPCTCGKQATKYLVQQESPFVMMSAPPAQYELKHGTFTCASEYTGNYQCGHYKHITSKETLYCIDGALLTKSSEYKGPITDVFYKENSYTTTIKPVTYKLDGVVCTEIDPKLDNYYKKDNSYFTEQPIDLVPNQPYPNASFDNFKFVCDNIKFADDLNQLTGYKKPASRELKVTFFPDLNGDVVAIDYKHYTPSFKKGAKLLHKPIVWHVNNATNKATYKPNTWCIRCLWSTKPVETSNSFDVLKSEDAQGMDNLACEDLKPVSEEVVENPTIQKDVLECNVKTTEVVGDIILKPANNSLKITEEVGHTDLMAAYVDNSSLTIKKPNELSRVLGLKTLATHGLAAVNSVPWDTIANYAKPFLNKVVSTTTNIVTRCLNRVCTNYMPYFFTLLLQLCTFTRSTNSRIKASMPTTIAKNTVKSVGKFCLEASFNYLKSPNFSKLINIIIWFLLLSVCLGSLIYSTAALGVLMSNLGMPSYCTGYREGYLNSTNVTIATYCTGSIPCSVCLSGLDSLDTYPSLETIQITISSFKWDLTAFGLVAEWFLAYILFTRFFYVLGLAAIMQLFFSYFAVHFISNSWLMWLIINLVQMAPISAMVRMYIFFASFYYVWKSYVHVVDGCNSSTCMMCYKRNRATRVECTTIVNGVRRSFYVYANGGKGFCKLHNWNCVNCDTFCAGSTFISDEVARDLSLQFKRPINPTDQSSYIVDSVTVKNGSIHLYFDKAGQKTYERHSLSHFVNLDNLRANNTKGSLPINVIVFDGKSKCEESSAKSASVYYSQLMCQPILLLDQALVSDVGDSAEVAVKMFDAYVNTFSSTFNVPMEKLKTLVATAEAELAKNVSLDNVLSTFISAARQGFVDSDVETKDVVECLKLSHQSDIEVTGDSCNNYMLTYNKVENMTPRDLGACIDCSARHINAQVAKSHNIALIWNVKDFMSLSEQLRKQIRSAAKKNNLPFKLTCATTRQVVNVVTTKIALKGGKIVNNWLKQLIKVTLVFLFVAAIFYLITPVHVMSKHTDFSSEIIGYKAIDGGVTRDIASTDTCFANKHADFDTWFSQRGGSYTNDKACPLIAAVITREVGFVVPGLPGTILRTTNGDFLHFLPRVFSAVGNICYTPSKLIEYTDFATSACVLAAECTIFKDASGKPVPYCYDTNVLEGSVAYESLRPDTRYVLMDGSIIQFPNTYLEGSVRVVTTFDSEYCRHGTCERSEAGVCVSTSGRWVLNNDYYRSLPGVFCGVDAVNLLTNMFTPLIQPIGALDISASIVAGGIVAIVVTCLAYYFMRFRRAFGEYSHVVAFNTLLFLMSFTVLCLTPVYSFLPGVYSVIYLYLTFYLTNDVSFLAHIQWMVMFTPLVPFWITIAYIICISTKHFYWFFSNYLKRRVVFNGVSFSTFEEAALCTFLLNKEMYLKLRSDVLLPLTQYNRYLALYNKYKYFSGAMDTTSYREAACCHLAKALNDFSNSGSDVLYQPPQTSITSAVLQSGFRKMAFPSGKVEGCMVQVTCGTTTLNGLWLDDVVYCPRHVICTSEDMLNPNYEDLLIRKSNHNFLVQAGNVQLRVIGHSMQNCVLKLKVDTANPKTPKYKFVRIQPGQTFSVLACYNGSPSGVYQCAMRPNFTIKGSFLNGSCGSVGFNIDYDCVSFCYMHHMELPTGVHAGTDLEGNFYGPFVDRQTAQAAGTDTTITVNVLAWLYAAVINGDRWFLNRFTTTLNDFNLVAMKYNYEPLTQDHVDILGPLSAQTGIAVLDMCASLKELLQNGMNGRTILGSALLEDEFTPFDVVRQCSGVTFQSAVKRTIKGTHHWLLLTILTSLLVLVQSTQWSLFFFXYENAFLPFAMGIIAMSAFAMMFVKHKHAFLCLFLLPSLATVAYFNMVYMPASWVMRIMTWLDMVDTSLSGFKLKDCVMYASAVVLLILMTARTVYDDGARRVWTLMNVLTLVYKVYYGNALDQAISMWALIISVTSNYSGVVTTVMFLARGIVFMCVEYCPIFFITGNTLQCIMLVYCFLGYFCTCYFGLFCLLNRYFRLTLGVYDYLVSTQEFRYMNSQGLLPPKNSIDAFKLNIKLLGVGGKPCIKVATVQSKMSDVKCTSVVLLSVLQQLRVESSSKLWAQCVQLHNDILLAKDTTEAFEKMVSLLSVLLSMQGAVDINKLCEEMLDNRATLQAIASEFSSLPSYAAFATAQEAYEQAVANGDSEVVLKKLKKSLNVAKSEFDRDAAMQRKLEKMADQAMTQMYKQARSEDKRAKVTSAMQTMLFTMLRKLDNDALNNIINNARDGCVPLNIIPLTTAAKLMVVIPDYNTYKNTCDGTTFTYASALWEIQQVVDADSKIVQLSEISMDNSPNLAWPLIVTALRANSAVKLQNNELSPVALRQMSCAAGTTQTACTDDNALAYYNTTKGGRFVLALLSDLQDLKWARFPKSDGTGTIYTELEPPCRFVTDTPKGPKVKYLYFIKGLNNLNRGMVLGSLAATVRLQAGNATEVPANSTVLSFCAFAVDAAKAYKDYLASGGQPITNCVKMLCTHTGTGQAITVTPEANMDQESFGGASCCLYCRCHIDHPNPKGFCDLKGKYVQIPTTCANDPVGFTLKNTVCTVCGMWKGYGCSCDQLREPMLQSADAQSFLNRVCGVSAARLTPCGTGTSTDVVYRAFDIYNDKVAGFAKFLKTNCCRFQEKDEDDNLIDSYFVVKRHTFSNYQHEETIYNLLKDCPAVAKHDFFKFRIDGDMVPHISRQRLTKYTMADLVYALRHFDEGNCDTLKEILVTYNCCDDDYFNKKDWYDFVENPDILRVYANLGERVRQALLKTVQFCDAMRNAGIVGVLTLDNQDLNGNWYDFGDFIQTTPGSGVPVVDSYYSLLMPILTLTRALTAESHVDTDLTKPYIKWDLLKYDFTEERLKLFDRYFKYWDQTYHPNCVNCLDDRCILHCANFNVLFSTVFPPTSFGPLVRKIFVDGVPFVVSTGYHFRELGVVHNQDVNLHSSRLSFKELLVYAADPAMHAASGNLLLDKRTTCFSVAALTNNVAFQTVKPGNFNKDFYDFAVSKGFFKEGSSVELKHFFFAQDGNAAISDYDYYRYNLPTMCDIRQLLFVVEVVDKYFDCYDGGCINANQVIVNNLDKSAGFPFNKWGKARLYYDSMSYEDQDALFAYTKRNVIPTITQMNLKYAISAKNRARTVAGVSICSTMTNRQFHQKLLKSIAATRGATVVIGTSKFYGGWHNMLKTVYSDVENPHLMGWDYPKCDRAMPNMLRIMASLVLARKHTTCCSLSHRFYRLANECAQVLSEMVMCGGSLYVKPGGTSSGDATTAYANSVFNICQAVTANVNALLSTDGNKIADKYVRNLQHRLYECLYRNRDVDTDFVNEFYAYLRKHFSMMILSDDAVVCFNSTYASQGLVASIKNFKSVLYYQNNVFMSEAKCWTETDLTKGPHEFCSQHTMLVKQGDDYVYLPYPDPSRILGAGCFVDDIVKTDGTLMIERFVSLAIDAYPLTKHPNQEYADVFHLYLQYIRKLHDELTGHMLDMYSVMLTNDNTSRYWEPEFYEAMYTPHTVLQAVGACVLCNSQTSLRCGACIRRPFLCCKCCYDHVISTSHKLVLSVNPYVCNAPGCDVTDVTQLYLGGMSYYCKSHKPPISFPLCANGQVFGLYKNTCVGSDNVTDFNAIATCDWTNAGDYILANTCTERLKLFAAETLKATEETFKLSYGIATVREVLSDRELHLSWEVGKPRPPLNRNYVFTGYRVTKNSKVQIGEYTFEKGDYGDAVVYRGTTTYKLNVGDYFVLTSHTVMPLSAPTLVPQEHYVRITGLYPTLNISDEFSSNVANYQKVGMQKYSTLQGPPGTGKSHFAIGLALYYPSARIVYTACSHAAVDALCEKALKYLPIDKCSRIIPARARVECFDKFKVNSTLEQYVFCTVNALPETTADIVVFDEISMATNYDLSVVNARLRAKHYVYIGDPAQLPAPRTLLTKGTLEPEYFNSVCRLMKTIGPDMFLGTCRRCPAEIVDTVSALVYDNKLKAHKDKSAQCFKMFYKGVITHDVSSAINRPQIGVVREFLTRNPAWRKAVFISPYNSQNAVASKILGLPTQTVDSSQGSEYDYVIFTQTTETAHSCNVNRFNVAITRAKVGILCIMSDRDLYDKLQFTSLEIPRRNVATLQAENVTGLFKDCSKVITGLHPTQAPTHLSVDTKFKTEGLCVDIPGIPKDMTYRRLISMMGFKMNYQVNGYPNMFITREEAIRHVRAWIGFDVEGCHATREAVGTNLPLQLGFSTGVNLVAVPTGYVDTPNNTDFSRVSAKPPPGDQFKHLIPLMYKGLPWNVVRIKIVQMLSDTLKNLSDRVVFVLWAHGFELTSMKYFVKIGPERTCCLCDRRATCFSTASDTYACWHHSIGFDYVYNPFMIDVQQWGFTGNLQSNHDLYCQVHGNAHVASCDAIMTRCLAVHECFVKRVDWTIEYPIIGDELKINAACRKVQHMVVKAALLADKFPVLHDIGNPKAIKCVPQADVEWKFYDAQPCSDKAYKIEELFYSYATHSDKFTDGVCLFWNCNVDRYPANSIVCRFDTRVLSNLNLPGCDGGSLYVNKHAFHTPAFDKSAFVNLKQLPFFYYSDSPCESHGKQVVSDIDYVPLKSATCITRCNLGGAVCRHHANEYRLYLDAYNMMISAGFSLWVYKQFDTYNLWNTFTRLQSLENVAFNVVNKGHFDGQQGEVPVSIINNTVYTKVDGVDVELFENKTTLPVNVAFELWAKRNIKPVPEVKILNNLGVDIAANTVIWDYKRDAPAHISTIGVCSMTDIAKKPTETICAPLTVFFDGRVDGQVDLFRNARNGVLITEGSVKGLQPSVGPKQASLNGVTLIGEAVKTQFNYYKKVDGVVQQLPETYFTQSRNLQEFKPRSQMEIDFLELAMDEFIERYKLEGYAFEHIVYGDFSHSQLGGLHLLIGLAKRFKESPFELEDFIPMDSTVKNYFITDAQTGSSKCVCSVIDLLLDDFVEIIKSQDLSVVSKVVKVTIDYTEISFMLWCKDGHVETFYPKLQSSQAWQPGVAMPNLYKMQRMLLEKCDLQNYGDSATLPKGIMMNVAKYTQLCQYLNTLTLAVPYNMRVIHFGAGSDKGVAPGTAVLRQWLPTGTLLVDSDLNDFVSDADSTLIGDCATVHTANKWDLIISDMYDPKTKNVTKENDSKEGFFTYICGFIQQKLALGGSVAIKITEHSWNADLYKLMGHFAWWTAFVTNVNASSSEAFLIGCNYLGKPREQIDGYVMHANYIFWRNTNPIQLSSYSLFDMSKFPLKLRGTAVMSLKE

SEQ ID NO: 11 - protein, 1273 aa, Unknown; identical to SEQ ID NO: 3
  SARS-CoV-2

SEQ ID NO: 12 - DNA, 29874 bp, Unknown
  SARS-CoV-2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctttcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacgtttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaa

SEQ ID NO: 13 - protein, 4405 aa, Unknown [sequence omitted]

SEQ ID NO: 14 - protein, 1273 aa, Unknown
  SARS-CoV-2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 15 - DNA, 29885 bp, Unknown
  SARS-CoV-2
  misc_feature (1)..(30): n is a, c, g, or t
  misc_feature (29865)..(29865): n is a, c, g, or t
  misc_feature (29872)..(29885): n is a, c, g, or t
nnnnnnnnnnnnnnnnnnnnnnnnnnnnnnaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagkccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctrataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagtttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagmcaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaatgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaaacgaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagnatgacannnnnnnnnnnnnn

SEQ ID NO: 16 - protein, 4405 aa, Unknown [sequence omitted]

SEQ ID NO: 17 - protein, 1273 aa, Unknown
  SARS-CoV-2
  misc_feature (320)..(320): Xaa can be any naturally occurring amino acid
  misc_feature (709)..(709): Xaa can be any naturally occurring amino acid
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRXQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSXNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRVSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 18 - DNA, 29897 bp, Unknown
  SARS-CoV-2
  misc_feature (11288)..(11293): n is a, c, g, or t
  misc_feature (22278)..(22283): n is a, c, g, or t
  misc_feature (29836)..(29864): n is a, c, g, or t
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcttctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacatcttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaactaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgttagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaattggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttacaagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatmtactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttatttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttagggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttkttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacytctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgnnnnnnaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactaytcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgcttcaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgctaaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtggtctccctcagggtttttcggctttagaaccattggtagatttgccaataggtattaacatcactaggtttcaaannnnnnctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaatattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttaaaggttttaattgttactttcctttacaatcatatggtttccaacccacttatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgtagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcatagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattactttaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcttgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagcgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagattttatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaatttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgnnnnnnnnnnnnnnnnnnnnnnnnnnnnnaaaaaaaaaaaaaaaaaaaaaaaaaaaaaaaaa

SEQ ID NO: 19 - protein, 1272 aa, Unknown
  SARS-CoV-2
  misc_feature (240)..(242): Xaa can be any naturally occurring amino acid
MFVFLVLLPLVSSQCVNLTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQXXXLHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 20 - DNA, 29819 bp, Unknown
  SARS-CoV-2
caactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagactttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgatactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgttttaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacacaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccggttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtgttaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaaatttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgtcgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttattacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgatacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagattgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaattttacaaacagaactcaattaccctctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaattatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagtgaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaacgattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttaaaggttttaattgttactttcctttacaatcatatggtttccaacccacttatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaatcaggttgctgttctttatcagggtgttaactgcacagaagtccctgttgctattcatgcagatcaacttactcctacttggcgtgtttattctacaggttctaatgtttttcaaacacgtgcaggctgtttaataggggctgaatatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctattaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcatttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcacccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccagaaacctaaattgggtagtcttgtagtgcgttgttcgttctatgaagactttttagagtatcatgacgttcgtgttgttttagatttcatctaaacgaacaaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtcgagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagctctaaacgaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctaaccccatgtgattttaatagcttctta

SEQ ID NO: 21 - protein, 1273 aa, Unknown
  SARS-CoV-2
MFVFLVLLPLVSSQCVNFTNRTQLPSAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNYPFLGVYYHKNNKSWMESEFRVYSSANNCTFEYVSQPFLMDLEGKQGNFKNLSEFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASFVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22 - DNA, 29883 bp, Unknown
  SARS-CoV-2
  misc_feature (29849)..(29883): n is a, c, g, or t
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtctgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactattattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaatctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgataacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttattttacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgttactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattacaatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcartagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacctggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcatcttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacctcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataggcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtaggatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggatattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttgtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccacttatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgatgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcatcggcgggcacgtagtgtagctagtcaatccatcattgcctacactatgtcacttggtgcagaaaattcagttgcttactctaataactctattgccatacccataaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatccttgcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacacacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtacttaacatcaaccatatgtagttgatgacccgtgtcctattcacttctattctaaatggtatattagagtaggagctataaaatcagcacctttaattgaattgtgcgtggatgaggctggttctaaatcacccattcagtgcatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaatgtctctaaatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaaacgaacttctcctgctagaatggctggcaatggcggtgatgctgctcttgctttgctgctgcttgacagattgaaccagcttgagagcaaaatgtttggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgnnnnnnnnnnnnnnnnnnnnnnnnnnnnnnnnnnn

SEQ ID NO: 23 - protein, 1270 aa, Unknown
  SARS-CoV-2
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 24 - DNA, 29832 bp, Unknown
  SARS-CoV-2
aaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacatcttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgtctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttactaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccaaaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaattaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaagattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctctaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcatatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctattcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttgtatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattaccggtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcatagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggtagattccaacggtactattaccgttgaagagcttaaaaagctccttgaacaatggaacctagtaataggtttcctattccttacatggatttgtcttctacaatttgcctatgccaacaggaataggtttttgtatataattaagttaatttttctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactataatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaatttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacatttccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatcc

SEQ ID NO: 25 - protein, 1273 aa, Unknown
  SARS-CoV-2
MFVFLVLLPLVSIQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSCMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 26 - DNA, 29816 bp, Unknown
  SARS-CoV-2
actttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacatcttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgttacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccactggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaatatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcttcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactgtctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcatatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctattcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttgtatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattaccggtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagcgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcatagcgcttccaaaatcataaccctcaaaaagagatggcaactagcactctccaagggtgttcactttgtttgcaacttgctgttgttgtttgtaacagtttactcacaccttttgctcgttgctgttggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaatttttctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaactaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactataatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaatttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacatttccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagc

SEQ ID NO: 27 - protein, 1273 aa, Unknown; identical to SEQ ID NO: 25
  SARS-CoV-2

SEQ ID NO: 28 - protein, 419 aa, Unknown
  SARS-CoV-2
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 29 - protein, 222 aa, Unknown
  SARS-CoV-2
MADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQ

SEQ ID NO: 30 - DNA, 10 bp, Artificial Sequence
  Synthetic
aacgttcgag

SEQ ID NO: 31 - DNA, 11 bp, Artificial Sequence
  Synthetic
  misc_feature (1)..(11): n=2'-deoxy-7-deazaguanosine
tcnaacnttcn

SEQ ID NO: 32 - DNA, 22 bp, Artificial Sequence
  Synthetic
  misc_feature (1)..(11): n=2'-deoxy-7-deazaguanosine
  misc_feature (11)..(12): may be linked by glycerol
  misc_feature (12)..(22): n=2'-deoxy-7-deazaguanosine
tcnaacnttcnncttncaanct

What is claimed is:

1. A severe acute respiratory syndrome coronavirus 2 (SARS-CoV-2) immunogenic composition comprising i) an inactivated SARS-CoV-2 whole virus particle comprising an S protein having at least 96% amino acid sequence identity to SEQ ID NO: 3; ii) a CpG-containing oligodeoxynucleotide (CpG-ODN) consisting of the sequence of SEQ ID NO: 4; and iii) an alum adjuvant;

wherein the immunogenic composition induces neutralizing antibodies against SARS-CoV-2 in a subject immunized intramuscularly with the immunogenic composition; and wherein the immunogenic composition does not induce antibody-dependent enhancement of SARS-CoV-2-associated disease in the subject.

2. The SARS-CoV-2 immunogenic composition according to claim 1, wherein the S protein has at least 99% amino acid sequence identity to SEQ ID NO: 3.

3. The SARS-CoV-2 immunogenic composition according to claim 1, wherein the alum adjuvant is aluminium hydroxide.

4. The SARS-CoV-2 immunogenic composition according to claim 1, wherein the alum:CpG-ODN (w/w) ratio in the immunogenic composition is between about 1:3 and about 3:1.

5. The SARS-CoV-2 immunogenic composition according to claim 4, wherein the alum:CpG-ODN (w/w) ratio in the immunogenic composition is about 1:2.

6. The SARS-CoV-2 immunogenic composition according to claim 1, wherein the alum content of the immunogenic composition is between about 0.8 to about 1.2 mg/mL.

7. The SARS-CoV-2 immunogenic composition according to claim 6, wherein the alum content of the immunogenic composition is about 1 mg/mL, and wherein the immunogenic composition is delivered in a volume of 0.5 mL.

8. The SARS-CoV-2 immunogenic composition according to claim 1, wherein the CpG-ODN content of the immunogenic composition is between about 1.5 to about 2.5 mg/mL.

9. The SARS-CoV-2 immunogenic composition according to claim 8, wherein the CpG-ODN content of the immunogenic composition is about 2 mg/mL, and wherein the immunogenic composition is delivered in a volume of 0.5 mL.

10. The SARS-CoV-2 immunogenic composition according to claim 1, wherein the amount of inactivated SARS-CoV-2 whole virus particles per 0.5 mL dose in the immunogenic composition is between about 0.25 and about 2.5 mAU (milli-absorption units×minutes) as assessed by size exclusion chromatography-high performance liquid chromatography (SEC-HPLC).

11. The SARS-CoV-2 immunogenic composition according to claim 1, wherein the amount of inactivated SARS-CoV-2 whole virus particles per 0.5 mL dose in the immunogenic composition is 35 Antigen Units as determined by SARS-CoV-2 enzyme-linked immunosorbent assay (ELISA) assay.

12. The SARS-CoV-2 immunogenic composition according to claim 1, wherein the amount of free (unbound) CpG-ODN in the immunogenic composition is about 80% to about 90% (w/w), based on the total amount of CpG-ODN in the immunogenic composition.

13. The SARS-CoV-2 immunogenic composition according to claim 1, wherein the whole virus particle is a beta-propiolactone-inactivated SARS-CoV-2 particle.

14. The SARS-CoV-2 immunogenic composition according to claim 1,
wherein the inactivated SARS-CoV-2 whole virus particle comprises an RNA sequence corresponding to a DNA sequence (i) of SEQ ID NO: 9; or (ii) having at least 90% sequence identity to SEQ ID NO: 9; and/or
wherein the immunogenic composition comprises an additional SARS-CoV-2 particle that comprises an RNA sequence corresponding to a DNA sequence (i) of SEQ ID NO: 18; or (ii) having at least 90% sequence identity to SEQ ID NO: 18; and/or
wherein the immunogenic composition comprises an additional SARS-CoV-2 particle that comprises an RNA sequence corresponding to a DNA sequence (i) of SEQ ID NO: 22; or (ii) having at least 90% sequence identity to SEQ ID NO: 22.

15. The SARS-CoV-2 immunogenic composition according to claim 14,
wherein the inactivated SARS-CoV-2 whole virus particle comprises an RNA sequence corresponding to a DNA sequence (i) of SEQ ID NO: 9; or (ii) having at least 95% sequence identity to SEQ ID NO: 9; and/or
wherein the immunogenic composition comprises an additional SARS-CoV-2 particle that comprises an RNA sequence corresponding to a DNA sequence (i) of SEQ ID NO: 18; or (ii) having at least 95% sequence identity to SEQ ID NO: 18; and/or
wherein the immunogenic composition comprises an additional SARS-CoV-2 particle that comprises an RNA sequence corresponding to a DNA sequence (i) of SEQ ID NO: 22; or (ii) having at least 95% sequence identity to SEQ ID NO: 22.

16. The SARS-CoV-2 immunogenic composition according to claim 15,
wherein the inactivated SARS-CoV-2 whole virus particle comprises an RNA sequence corresponding to a DNA sequence (i) of SEQ ID NO: 9; or (ii) having at least 99% sequence identity to SEQ ID NO: 9; and/or
wherein the immunogenic composition comprises an additional SARS-CoV-2 particle that comprises an RNA sequence corresponding to a DNA sequence (i) of SEQ ID NO: 18; or (ii) having at least 99% sequence identity to SEQ ID NO: 18; and/or
wherein the immunogenic composition comprises an additional SARS-CoV-2 particle that comprises an RNA sequence corresponding to a DNA sequence (i) of SEQ ID NO: 22; or (ii) having at least 99% sequence identity to SEQ ID NO: 22.

17. A kit comprising a SARS-CoV-2 immunogenic composition according to claim 1, and further comprising a second immunogenic composition.

18. The kit according to claim 17, wherein the second immunogenic composition is another SARS-CoV-2 virus immunogenic composition, a Japanese encephalitis virus immunogenic composition, a Zika virus immunogenic composition, a Dengue virus immunogenic composition, an influenza virus immunogenic composition, or a Chikungunya virus immunogenic composition.

19. A method of producing a severe acute respiratory syndrome coronavirus 2 (SARS-CoV-2) immunogenic composition, comprising:
(a) producing SARS-CoV-2 whole virus particles comprising an S protein having at least 96% amino acid sequence identity to SEQ ID NO: 3;
(b) inactivating the SARS-CoV-2 whole virus particles to obtain inactivated SARS-CoV-2 whole virus particles; and
(c) incorporating the inactivated SARS-CoV-2 whole virus particles in a immunogenic composition comprising a CpG-containing oligodeoxynucleotide (CpG-ODN) and an alum adjuvant, wherein said CpG-ODN consists of the sequence of SEQ ID NO: 4;
wherein the immunogenic composition induced neutralizing antibodies against SARS-CoV-2 in a subject immunized intramuscularly with the immunogenic composition; and
wherein the immunogenic composition does not induce antibody-dependent enhancement of SARS-CoV-2-associated disease in the subject.

20. The method according to claim 19, wherein said alum adjuvant is aluminium hydroxide.

21. The method according to claim 19, wherein the alum:CpG-ODN (w/w) ratio in the immunogenic composition is between about 1:3 and about 3:1.

22. The method according to claim 21, wherein the alum:CpG-ODN (w/w) ratio in the immunogenic composition is about 1:2.

23. The method according to claim 19, wherein the alum content of the immunogenic composition is between about 0.8 to about 1.2 mg/mL.

24. The method according to claim 23, wherein the alum content of the immunogenic composition is about 1 mg/mL, and wherein the immunogenic composition is delivered in a volume of 0.5 mL.

25. The method according to claim 19, wherein the CpG-ODN content of the immunogenic composition is between about 1.5 to about 2.5 mg/mL.

26. The method according to claim 25, wherein the CpG-ODN content of the immunogenic composition is about 2 mg/mL, and wherein the immunogenic composition is delivered in a volume of 0.5 mL.

27. The method according to claim 19, wherein the amount of inactivated SARS-CoV-2 whole virus particles per dose in the immunogenic composition is 35 Antigen Units as determined by SARS-CoV-2 ELISA assay.

28. The SARS-CoV-2 immunogenic composition according to claim 1, wherein the inactivated SARS-CoV-2 whole virus particle comprises an RNA sequence corresponding to a DNA sequence (i) of SEQ ID NO: 9; or (ii) having at least 95% sequence identity to SEQ ID NO: 9.

29. The SARS-CoV-2 immunogenic composition according to claim 1, wherein the immunogenic composition comprises an additional SARS-CoV-2 particle that comprises an RNA sequence corresponding to a DNA sequence (i) of SEQ ID NO: 18; or (ii) having at least 95% sequence identity to SEQ ID NO: 18.

30. The SARS-CoV-2 immunogenic composition according to claim 1, wherein the immunogenic composition comprises an additional SARS-CoV-2 particle that comprises an RNA sequence corresponding to a DNA sequence (i) of SEQ ID NO: 22; or (ii) having at least 95% sequence identity to SEQ ID NO: 22.

* * * * *